United States Patent 10,279,031 (COMPOSITION COMPRISING ANTIGENS AND A MUCOSAL ADJUVANT AND A METHOD FOR USING) - sequence listing, part 4

SEQ ID NO: 4 - DNA, 2277540 bp, Haemophilus parasuis
gttgtgctaaaggacacgatattgatgtgcagaacctaagttacaaagctggcgatagctaccttgcccacgcttatggtaagagcaatcagccagttgtctttattgacagcacagggcgtagctatgctcttgatcctcttagcctaccttctgctcgttcgcaaggtgaacctattacgggtaaaatcagtttacctgatggggcaacggtgcaatatgtactaatggctgaggaaagtcgtaaggtactaatggcttcggattcgggctacgggtttatttgccaatttgaagatctggtttctcgcaacaaggcagggaaagcggttatttccttaacggaaaatgcaaaagtgctaccaccgcagttgttaaaagagggtgaagaaaatctgttagtggcaatgagcaatacagggcgagtgttagtcttcccagtttctgaattgcctgagttatctaaaggcaagggaaataagatcatcaacatttctgcacaagctgcgaaagaacgagcagagctactttctcgattacttataatcaacccaacaagttcgctggttttcgtttcaggtaaacgtaaaattacgctaaaaccaacagatattgaacattatcgtggcgaacgtgcaagaaaaggcacgcaacttcgagggctaagtggtaatgttgaagttgaaattgtagattaatctcaaggggagttgcattccccttgatacattctatcgaacctctaccacctgacttaccacctttccctgtgctaaacgagtgactatcgtttcaccgattgaaatatcctgagtggatagcagtgctttgccctgttggttttgtgtcacagaataaccccttgccaaaatagaaagtgggcttaagccgtctaactgagtgcaaagagtttgaaattgcaggcgacgttggttgatattcttctcaatggcatagcttaaacgttgctctagcttgtgcaaatgttgtatttgggctgaaatacggtaaggaagcggatttcgttccattcgttgtagtgtatttttccaacgctgttgtttacgcaacaatagctgttccatctgctgtttcagctgtttttctaagtgcgaaagctgttggaggcgttgctgtaattgacgctgtgggtgttgagcctgtaaacgcagttgcaagcggtcaaatcgggctaatttttcactccataagcgatcaaaagctaaattcactttatcagagtgatgttgtaactgtcgtaacaactcttgttgatcacggctgaccaactctgccgcagccgatggcgttggcgcacgcaaatctgccacaaaatctgcaatagttacatcggtttcgtgtccaacggcactgataatcgggatctgagagtgataaatcgcccaagcgaccgcttcttcattaaagcaccataaatcttccagtgagccaccgccacgcccaacaatcagcacatcacattcctgacggcggttcgccagctcgatcatctgcacaatatcggctgtcgcttctttgccttgcactaaggtcggataaatcacaacttcaagagttgggtcgcgacgttgtaaaatatgcaaaatatcttgcaacgccgcaccacttgatgaagtcacaatgccaacacgtttaacgaacgtaggaataggctttttatgttcttgagcaaataaccctaacccagccaatttcattttaagctgttcaaattgctgttgtaacaagccatcgccagcaggttgcattgtttcaataataacttgataatcacctcgtggctcatacaggctaacattcgctctcaccaatacttgcattccattttgcggacggaaattcactcgcatatttttcatacgaaacattgcacaacgcacctgcgcttgttcgtctttcagggttaaataccaatgcccagaaacaggttgcgaaaagtttgaaatctcgccgataagccaaacactgccaaattcgacttcaagcatctgtttaacggagtaattgagctgactgatggttaggatatggtttttcataataaaatttaaaggattcaatatgttatcctcaaataaattatccccttgtcaatattgtaactaaaacaaataatgacaagaggataacacaacaaatctctttgttaattttatggataaacaggtagacgtttacaaatatccaaaactttcactttagtcgcttcaattaccgcagcttcgttatccttaccgatgttatctaatacatcgcacatccaacctgcaagttcccgtacttcagcctctttaaaaccacgacgagttacagatggagtaccaacacgaataccagaagtaatgaatggtttttgtggatcgttcggtactgcatttttattaacagtaatatttgctttacctaaagctgcatctgccgctttacccgttaaaccgtggctcactaaatcaacaaggaataagtggttttctgtaccatttgaaacaacgttatagccacgttgtttaaatacttccaccatggcttttgcatttttcaccacttgttgttgataagctttatattcagattctaacgcttctttaaagcaaaccgctttggcagctattacatgaactaatgggccaccttgactagcagggaaaactgcactttgtagtttttggtataactcttcatcttttgcacttgaaagaattaaaccaccacgagggccacctaaagttttatgtgtagttgttgttacaatatgagcatgaggtaatgggcttggataaacgcctgcagcaattaatcctgcaacatgagccatatcgacaaataaataagcccctacttcatcagcaatttcacgcatttttgcccaatcaactacttgtgaataggcagagaaaccgccaacaatcattttaggcttaacttcgtgagcttgcttacgaagagcatcataatcaataacgccttctgatgtaataccgtattgttcggcatgatagatttttccagagaaactaacagatgcgccatgagttaagtgaccaccgtgagccaaactcatccctaaaatagtatcacctggatttaatagagccatatacacagctgcatttgcttgagaaccagagtgcggctgtacgttcacataatctgcattgaataactcttttgcacgttcaatcgctaactgctctacaatatctgcatattcacagcctccataataacgtttaccaggataaccttctgcgtatttgttggtaaattgtgaaccctgagcttccatcacacgaggacttgcatagttttcagaagcaataagttcaatatgctcttcttgacgacgattttcgccttgaatagcttgccataattctggatcataatctgcgatattcatatcacgtcttaacattggtttctcctataagtaatcgtttgcgtaattgatttatccatattctacgcagtttttttgactttagatagtagttttttctgatgattgtaataaaaatatcaagaagcaaactaaaactaagacttatatactatgatttatctcttttctaaacattaaaattgtaaaacctatcattagctctatgaaggcttacctacacaccattaaaattcgccttaaaactcactttattaccctcctacacatcgttccgcttgactacccccccttaaaatacaatagaaccgtccatttcttctgaagaaacgcctcaagcgcctgagctggtcattgatgattatcaacaagcctcttttgtagcaccacaagatgccgtaatctctggaagcggtgcagcactttttgaaacaacctctaatattgaaccggcatctaatatccctctctcctcagagacgctacccgcagcagcgacaaaccaaaataattcactcttatggtggacattaggcggtgtttcgctccttggcggaggagttgcgttggcgggaagttcaagtaaatcaggaaaaaataatagccatcaagaggcttcaccaccacccgttcaattagaaaaggttgctaataataatgtcattaactttagtgagtctaaccaaacaacaatagagattagcggcaaattaagacaacctctaaacgaaaatactgaacttaaactcttgttagatgggaaaccattagaaacagacatttctctatctgatactcaattttctgcgcatatcaatactcaactattcagccaacactaagaatgtgagtaagacgatttcattaactaatttttttgataattgacaataaaagttgaagaattcttgttattttattctttattttatgtaaatgttgtttttttttttttttttttacaatggagtgggggcatctgtacaccctgaaaatgtaaataaaagtttattatgctttattaggaaaagcgttagagaagaagattattatgaataaaatatttagagttatttggagtcacgctcaacaggcttgggttgttgtatctgaattagtaaagtctcataccaaaacatccacttacacgaataaaagagctcaactatgcacctcacattattttttagataaacagcaagataaatttaaattaagtcttttaagtctagtattactaagtatattttttagtccagtaggttcagcagcatggtttcaatatggtgctggtccatcgtctcgaggaagtaacgtcgattctattggtattggtaaaaatgctaaggttgggtctggtgctattgctattggtgggctctcaaaagctgaagctcatactagtattgcgataggttatagcataaaggcagaaggagagggctctattgcgattggtagagagtctattgcatctcaatatgaaggcattgctataggtcgtgcgagtttttctagctccaagcaatctgtcgccttaggcgcacgagccaaagcgacacagagtgaagcaattgcaataggttcaggtgctgcagcaagttcgatacaatctgttgctatcgggaaaaataccaaagcgagtgggtatagttccatatcaatcggttatagtgcaaatgcagcagcatcagaatctatctccttaggtctagcctcacaagcaacccatacagaaggtgtagcaatcggtgcgagaagtacttcaaatggcaactatggtgtggctgtcggtagcagttctacagcttccgattatgccgttgctgttggtaaaagtgctattgcaaataaaacaggagcttccgcattcggtgaaaacgcaaaagcaaccgcagagcgtgcaacagcattggggaataatgccatagcagatacgaaatatggcgttgctctaggttatcaatccaagactagtcgtgattcagggcaaacgggttggataccaagtgatacaaattatactattaacggaaatacattatctgctacgcatgcagcggtagcagtaggtaatgataccaccgtcactcgtcaaattaccggtgttgctgcaggtacacaagatactgacgcagcaaacgtagcacaattaaaagcactgactttaaagatcagtggcgatgaagatacgaagggtcacacaacactttctactgaaacgctctcaattgtagggtctggtggtattagtacggcagttgaccagggaaatggcaatacaaaaattacccttaaactgactcaaggtgagtttaactctacaactgatggcagattgttaacaaagacggcaggacttgcaactgttgatactgtagtcaatgctgtaaatgatgcaggctggaaactggcgatcgctcagggagcgggtggtcaagctactcctcttacaacaccacatcttatcaaaatgggtgagactgcaacctttaccgccggaaataatattaaattagaacaaacgaacggaaatattacgatttctacaactggtaagttaattaaagaaacgcaaatcttagagaatggcaatttggaaattacttatactgatggttcaaagaatactattgccaagggtatagatggtgcaccaggtcctgtgggtcctcggggccctgcgggtccaaagggagagcggggtgaaccaggtcctagaggtgaacaaggagaacaaggaccagcgggtctaacaggaccacaaggtgtaccaggtccagcaggtcctgcgggtgcagttggtccagcaggtccacaaggtgctaagggtgatccaggtcctgcgggagagcgcggtccagcaggtgcaatgggtccaacaggtcctcggggtcctgcaggtgagcaaggtccagcaggccctagaggtgaaaagggtcctaaaggtgatcagggactaagaggtgaaactggtccagcaggtccagtaggtcctgcgggtgcagttggtccagtaggtccacaaggtgctaagggtgagcaaggtcctgcgggtccagcaggtcctgcgggtccagcaggggctccaggagtagctggtcctaagggcgatagaggtgaagctggtccgaaaggtgaagcaggtccagcaggtgcaatcgggccaacaggtccaaggggagagcggggtccagcaggtgataagggtgataaaggtgatacgggtccgcaaggtccgatgggtcctccgggtccagtaggtccagcaggtcctacgggcccagcaggtcctcggggtcaacaaggtcctgcaggtgagcaaggtccagttggtcctgcgggtgcaacaggtcctgcgggtccaacaggtccagcaggtgctaagggtgataaaggtgatacgggtccagttggtccgcaaggtccgatgggtcctgcaggtgctaagggtgacaaaagtgaacagggtgagcgaggagaaacaggactacaaggtgcagcaggtccagcaggtcctcagggccctgctggtgcaacaggtgagcgcggtccgaaaggggatactggtctaagaggagagacaggtcctgcgggtccaacaggtcctcggggtgaaccaggtcctagaggtgacaaaggtgaacagggtgatccgggaccaaaaggtgaaactggtgcgacaggtcctgcgggtccagttggtccgacaggtcctgcaggtccaacaggtccgaaaggcgatacaggcccagcaggtcctaaaggagagcaaggtttaacgggtcagactggtccgcaaggtccagtgggtccacaaggaccgcaaggaatagcgggtgcaacaggacctaagggtgataaaggtgaacagggtgatcagggaccaagaggtgaagctggtccgaaaggtgaagcaggtccagcaggtcctgcaggacctaagggtgataaaggtgatgcgggtccagttggtccgacaggtcctgcgggtccaacaagtccgaaaggcgatacaggcccagcaggtcctaaaggagagcaaggtttaacgggtcagactggtccgcaaggtccagtggatccacaaggaccgcaaggaatagcgggtgcaacaggaccacagagtgtcagcggtttgccgatggagtatgctacggaagacggtaaatcgattatcaatatgggcggtaatttctatttggaagaacctgccgcagatggttcgattaagttaattccagtggtcaatgctagaggtaaattctcaactaaaacacaaaatccagatggtagtgttatgcttaagccattagtggtaaaaaaagtgaatttggcgaatcaagctcctatggtgctgggtaatgtggctaaaggggtagcagatacggacgctgttaatgttaaacagttgaaattgacaagaactgaggttgaagcgggtaaaaatgtgaaagtgacttcacaaacgggtgcaaatgatcagaatatttacaaggtgagcgtgtctggagatttaagcgacattacttcaattagtaatggcgatacgaaagtatctttaggtaaagatgagcaaggaaatccagttgtaaatatgaatggtgccagaattaccaacattggagatggtagtactgagggcgatgttgtgaatgttcgtcagctcaacacagtggtttcttcgatgaatgctggatttaatcaattgtcgaaagatattggtcgtgttgatgtcaatgcaagagcaggtattgcatctgctggggcaatggcgaatttacctcaagtaaatttaccaggtaaaggtgcgatttccgtttctagtgcacaatatcgtggacaagcagcttatgcaattggctactcaaaaatttctgataatggcaaatggggtattcgagcgtctgttagcagtaatactcagcgggatactatgattggaggaggggtaagttttgtgtggtaatctagcacctataaattagaatttcatgctcaatgccattgttattttaacaatggcattgttttctatagtggggagactcactcaaactgatttcagataaaactaaaattaccttccaagaaagtagcgaggaattcctagcagacggaacaggcattaactttgtattttctgaaatgaaagaatccctactcggatttgcgagtcacggcggtaacgtgcatttgaatgccctgaaattttctgacaagctcaccccagaaaaccaaggaatttctacccttttacacgaaaccatgcatgcgttagcattaaaacacccttttgcacctactctaccctgccaatgtcgccaccatcaccgctttaatcgtatgcatacgattttctgcttcatcaaaaacaatagaggcttcggattcaaatacttcatccgttacttctaatccgttcattccatatttttctgcaatttctttacccacaagggtttggtcatcgtggaaagcgggtagacaatgtaagaattttacatttggattacccgttaatttcatcaattcagcattcacttgataaggcttcattaaattgatacgagattcccaagcggattctggttcgcccattgatacccaaacgtccgtatagacgaaatcaacatctttaaccccttctgcaacatcttccgtacaggtgatttttgctcctgttttcgtagccatttccgcgacttcgtctaataatgtttgttcaggaaagaactgtttaggtgcaactaaacgtaaatccacccccattaatgcagccccctcaacaaaggaatttcccatattgttacgcgcatcacctaagtaagcgagcttaatttgattaagtggcttatttgaatgttcgatcatcgtaaggaaatcggcaagaatttgagttgggtgaaattcatcggttaaaccgttccaaacaggtacacctgaataatctgctaatgtttgaactaatacttgtccataaccacgatattgaataccgtcatacattctacccagtacacgagcggtatctttcattgactctttatgtccaatctgcgatccgctaggtccaatataactcacattcgccccctgatcgaaagcagccacttcaaaggcacaacgtgtgcgagttgagcttttttcaaagatcaatgcgatatttttgccttgcattgttgggacttctcgacctgcttttttgtctgcttttaattttgcggataaatctagcaggtattgaatttcatttggggtgaaatccattagacgtaaaaaatggcgatttttaagattgatggtgtttgctgacataatgcttttcctgatttgaaataaataaggcttttattataaagcctttcaataagagaacaatgggaatttatgggagtgatgtatcttattgctttacatctcatctctttttctgtatagtttagcgatacaatcaggagggcagatgattatttcatttaagcataaaggattgaaattattttttgaaacaggatcaactgcaggtattcaggcaaatcacgctagtaaacttgcttttcaattagccactctaaaccaagcaaaaagtgctttagatatgaatgcacctagctggaatttacatcaattacaaggtaatctagctgggcattggtctatcaaggtaagtggaaattggcgtttaacttttaaatttcaaaatggtcacgctgaagtcgtggactatcaagattatcattaaggagctatcaatgaaaatgtacaatccagctcacccagggcttattttaagagaatatattgaaggatataatgtcacagaagtggctaaacgtttaggtgtcactcgtgtcacgctttctcgtattttaaatggcaaagctgcaatttcacctgaaatggctcttagattaagccaattattaaaaactagcccagaattatggcttggtttacaatcccaatacgatctttggcagcttgaacaacgcccaagttttaatattcagccgttatttgcatagcacttgttgtatgttgcaacgttctgctcaaaatttaccgcttgttgcttataggagaacataatgtctaaacaccttactgaacaacgttttattgattttccgattcacgacagtgtcttggctgctcttgatagcaaaggctttgaattttgcacaccaattcaagcgaaaacgttgccttatacactgatcggacaagatattgcagggcaagcccaaacaggaacagggaaaacccttgcattcatcgtggcgacctttcatcatctattaaatcacgatattccaaccaaacataatcaacctcgtgctttaattcttgcaccaacccgtgaacttgcggtacaaattgcctctgatgcatcaattttaacgcagtatgcggatctgcgtttagctcttgcctatggtggtgacggctacgacaaacaactacaagagattgagcgtggagttgatattttaatcggcacaacaggacgggtgattgattatgtcaaacaaggcattattgatctcgataaaattcaagtcgtggtgttagatgaagcggatcgaatgttcgatctcggttttatcaaagatattcgctatttaatgcgaaaatgtccgaaacccgaagagcgtttaacaatgttgttctctgcaacgctctctcatcgtgtgcgtgaactggcatttgaagatatgcacaatgcagaatatgtggaaattgagccactacaacgcacagggcatcggattaaagaggaactgttctacccttctaatgaagataaaatggcattacttctaacattaatggaagaagagtggcctgatcgttgcattgtgtttgccaatactaaacataaatgcgaagaaatttggagctacctcagtgcagacggacatcgagttggcttgctaacaggcgatataccacagaaaaaacgcttggcattattggatagctttacgcaaggggaattagatattttggtggcaacagatgtagctgctcgaggtttacatattcctgatgtgacacacgtctttaactatgatttaccagacgaccgtgaggattatgttcaccgtataggaagaacaggacgagcaggggaaagtggagtttcgatcagctttgcttgtgaacgttatgccgtaaatctaccagcaattgaagaatatatcggacacgctatccctgttagtcaatacgatagtgaagtgcttttagcgttgccaaagccacaaaaagccaaaacaagaacactacaaggcaggaaatataaataaggagaaaaaatgaattacaccattgcacacagtaaatcaggcaatctcatttctttgaccgctaaaatggcaaaccgccacggtttaattgcaggagcaacaggaacagggaaaactgttacattgcgaaaacttgctgaaacttttagcaatgatggcgttcccgtattcctagttgatgtcaaaggtgacttatctggcttagtgcaagcgggaagttatcaaggaaaaattgcagaacgtatcgatcaatttggactgggtggtgaagcatacttaaacggatttccagtttctttctgggacgtattcggcgaatcaggcattccattacgcacaactatttcagaaatgggtccgatgctactcgcccgtttactgaatttaaatgatacccaagaaggcttattaaacctcgttttccgtgtcgctgatgatcaggggttattactgattgaccttaaagatcttcgtgcaatgctcaaatttgttgcagaaaatgccaaaacattccaagttgaatatggtaacgtttctgccgcaagtgtcggtgcaattcaacgagcattactagcccttgaaaatgaaggggctgcaaatttatttggtgagcctgctttagatttacaagactggatccaaactcgtgatggacgtggtgtgatcaatgtgcttaactctgaaaaattaatcaattccccaagaatgtatggagctttcctgctttggtttatggcagaattatttgaacagcttcctgaagtgggcgatcctgataaacctaaatttgttctattctttgatgaggcacacttactatttgatggagcaccaaaagttttagtggataaaattgaacaagtagtacgtttaatccgttcaaaaggtgttggggtatattttgtcacacaaaacccactcgacctaccagaatccgtactaggacagcttggtaatcgagtgcaacacgctttgcgtgcttttacaccgaaagatcaaaaagcggtcaaatccgcagcggaaaccttccgcgccaatccaaatgtcaatgttgttgaagcgattacccaattaggggtaggtgaagcgttaatttctgtgttagatgaaaaaggaatgccaacaccagttgaaattgcctatgtttatccgccacaaagccaacttaaaccgatttcacaagaggaacgcctatctcttgtaaaacaggacgatctttacttccattatagccaatatgtcgataatgcttctgcctttgaaacactaaatgcacaggcacaagctcaacagcaagcggtagaacaagcaaaagcagaagaaaatagtttcttaggtggaatgctcggaagtatttttggcactaagaaaaagagtgaacaaactattgcagaacaagtggttagcggtgttgcccaatcggttggtagaaacctacgcaatcaagtcacaaaacagattatgcgtgggattttaggggcgattacgaaaaaataagagctgtaaagataaaattaatacgtggcggttaaactctgaaaaacacgattcctataagctaactgtaacaatttttttctgtctctgctctcatctctcatctcttctaactaacattaatatgaaaaatgcggcgtaaagccgcattttttataaattaaaatggaatatcatcatcaaaattatccattggtggttctgcttgagccgcaggtttttgggctggttgcggtctggttgcgttgcccccattgaagttgttattttgagcatagttgtcgctgtagccgccttgattgtagttggtttgcgctggtgcttggttccaaccgctaccttgatttccgccaaaatcaccgccactgctacggctgtctaacatttgtagtacatcgccttgaatttctgtggtgtaacgatcttgaccgttttgatcttgccatttgcgtgttttgagcttgccttctacataaacttttgaacctttgcgtaagtattgtcctgctacttctgcttgacgacggaagaaaacgatacggtgccattcggtgacctcacggcgttcgcctgtcattttatcgttccaactttcactggttgctacgcttaatgttgcaaccgcatcgccgtttggcattgtacgcatatcagggtcattaccgagattgccgacaataattactttatttacacctgccatatcaaatcctcttaaataaattgtgttggttaaatgtagttttgcgtagggacacactgcgtgtgtccgaaactatatgtttgtatttatcggggacacacgcagtgtgtccctacctcattagttcaaaaataatagttatgtatttttgtacataatattgtaaaacattaaaagttattttgcctgaaaataaaaaaaaaatcatctattaaaactgatattttgtacagttaatcaatttatgcgataatgatcgaaaatttgaaaatttttgctttacatttgtttagaaggcagttatgaaacatattgatattcgtggggcgagaacccacaatttaaaaaacgtgaatttggttcttccgagagataagtttattgtgattacggggttgtcagggtcaggcaaatcgtctttggcttttgataccctttatgctgaagggcaacgtcgttatgtggaaagtttatccgcttatgctcgccagttcttgtctttgatggaaaagcctgatgtcgatcatattgaaggactttcccctgcgatttcaattgagcagaaatctacctcgcacaatcctcgttctacggtgggaacggtgacggaaatccacgattatttgcgtttgttgtttgctcgtgtgggcgagcctcgctgtcctgatcacgatgtgccgttagcggctcagacgatttcgcaaatggtggatagagtgctggaagaacctgaaggtaagcgtttgatgttgctttctcctgtggtgaaagatcgtaaaggtgaacacgcaaaattattagaaaatctgaccgctaatggctatatccgtgccagaattgatggggaaatttgtgatctgtccgatccgccaaaacttgaattgcagaaaaaacatacgattgaagtggtaattgatcgttttaaagtgcgtagcgatattgcgacccgtttagctgagtcctttgaaacggcattggaactctcaggttcaacagcgattattgccgatatggacgatccaaatgcagaagagttagtgttttcgtcgagttttgcttgctctcactgtggctattcgctgacggaactagaaccacgccttttctcgtttaataatcctgctggggcttgcccaacttgtgatggtttgggagttcagcaatattttgatgaacgtaaagtggtgcaaaatcctgatatgtccttagcaagcggtgcgattaagggttgggatcgccgtagtttctactatttcggtttgttgaaatcagtggcgaaacattatgattttgatattgaaatgccgtttaatcagttaccgaagaaaattcaaaatatcattttaaatggttcaaaagatgaaattgaatttgtctatgtgaatgatcggggtgatagcgttaagcgagttcacacttttgaaggggtgctgaataatatggctcgtcggtataaggaaaccgagtcaaatgcagtgcgtgaagagctggctaaatatattaataatcgtacttgtaccgattgtgaaggctctcgtttacgtcgtgaagcccgttatgtctttttagaaaaaaccaacttgccgatggtgtcggaaaaaagtatcggcgaagccttagaattttttgaaggcttacatctgtctgggcagaaagcacaaattgcggaaaaaattctcaaagagatccgtgagcgtttgtctttccttgtcaatgttgggttgaactacctttcactctctcgttcggcagaaaccttatcaggtggtgaagctcaacgtattcgccttgccagccaaatcggtgcagggttagtgggagtgatgtacgtgcttgatgaaccgtctattggcttgcaccaacgagataatgaacgtttactaaacacgcttattcatcttcggaatttgggtaataccgtgattgtggttgaacacgatgaagatgcgattatggcggcggatcatattgtcgatattggaccaggggcaggggtacacggtgggcagattattgctcaaggtacggctcaagaaattatgcaaaatggagcatcaattacgggcaaattcttatcgggtaaggaaaaaatcgagatcccgaaacagcgtaccccacgagatgaaagcaaacagcttgtattaaagggggctagcggtaacaatctaaaagaagtcgatttagccattcctgtcggtctgtttacttgtattacgggggtatcgggttcgggcaaatccaccttaattaacgataccttattcccgattgctcaaaatgcgttaaaccgtgcagaaaacagcgatgtcgccccttataagagcattgacggattggcttatttcgacaaagtgatcgacatcaatcaaagcccgattggacgtacgccacgttcaaaccctgcgacttatacaggtttatttaccccgattcgtgaactctttgctggtacacaagaagcaagagcaaggggctatactgtcggacgtttcagctttaacgtgcgtggcggacgttgtgaagcctgccaaggtgacggggtgatcaaagttgaaatgcacttcttacctgatgtatatgtgccgtgcgaccactgtaaaggcaaacgctataaccgtgaaacccttgaaattcgctataaaggcaaaaccattcatcaagtgttagatatgactgtggaagaagctcgtgagttttttgatgccgtgccgatgattgcacgtaagctacaaactttaatagacgtaggcttatcctatatccgtttagggcaatcttctaccaccctgtcaggtggcgaagctcagcgggtgaaactggcagcggaattatccaaacgtgacacgggcaaaaccctctatattcttgatgaaccaacgacaggattacacttcgccgacattaaacaattattgaccgtattgcaccgcttgcgtgatcaaggaaataccattgtggtgatcgagcataacttagatgtgatcaaaacggcagactggattgtcgatctaggtcctgaaggcggtagcggtggcggacagattatcgccgaaggtacgcctgaagaggtggcaaaagataagaaatcccatacggcaagatttttaaaagagattttgaagaaaggttaagttgtagttgcaagcggtcacttcgttataatattttgcaaaaaaccaaacgaatccgaccgcttgtttgaaaggagaaaatgatggaataccaatttacacataccatgcacggcgttattgccaaatgttcaatggatcacgaggcatttgctcgttggttaaataccgagattgtgccaaatccaaaagagttaaccgctatttttgctgaaattgagcattgtcgccaaaccaaagatcaaaactacgaatggatttttgaaggtaaagaatatagcctttatatcaacattgaagaagtgatggtgaaagcaaataatctggatatgacatttgaagaaatcgaagatgtcgaaaacggctttagtttctatgatgaagaaagtatcgctttttgcggattagaagattttgaaatgtttttgaatgcctatcaaaaatttattcaaacctaccactaaacccactatagaaaacaatgccattgttaaaataacaatggcattgagcatgaaattctaatttataggtgctagattaccacacaaaacttgcccctcctccaatcatagtatcccgctgagtattactgctaacagacgctcgaataccccatttgccattatcagaaatttttgagtagccaattgcataagctgcttgtccacgatattgtgcaccagaaacggaaatcgcacttttacctggtaaatttacttgaggtaaattcgccattgccccagcagatgcaatacctgctcttgcattgacatcaacacgaccaatatctttcgacaattgattaaatccagcattcatcgaagaaaccactgtgttgagctgacgaacattcacaacatcgccctcagtactaccatctccaatgttggtaattctggcaccattcatatttacaactggatttccttgctcatctttccctaaagatactttcgtatcgccattactaattgaagtaatgtcgcttaaatctccagacacgctcaccttgtaaatattctgattatttgcacccgtttttgaagtcactttcacatttttacccgcttcaaccccttgcgctccttgtggacccaatggaccttgcggaccagtctgacccgttaaaccttgctctcctttaggacctgctgggcctgtatcgcctttcggacctgttggacccgcaggacctgttggaccagtttcaccttgtggtcccgcatcacctttatcacccttaggtcctgttgcaccagcagggccctgaggacctgttggacccgcaggacctgtctctcctcttggaccagtatcccctttcggaccttgctcgcctcgctctcccgctggaccttgaataccttgatcacccttagcacctgcaggacctgcttcaccccgagcccctgctggacctgctggacccacaggacctgtcggacctgctggacctacttcacctttatcacccttaggtcccggagtacccgctattcctggcggtccttgttctcctcgttcacctctttgcccagttggacctactggtcctgcttcaccagggtcacctttatcgccttttgctcccgtttcccctcttggaccttgaacaccagctggacccgcaggacctgtcggaccagtttcacctcttggtccttgatcaccctgttcacctttatcacccttaggtcctgctggacctataggacctggttcacccttagcacctgcaggaccttgtggacccattggaccaacttcacctctattgcccttaggacctgctggacctgctgcaccttgtagtcctgtttctcctcgctcacccctagcacctgcaggacctggttcaccccgaggacctgctggacctgtttgtcctattgcaccttgtggtcctgttggacccgctggtccttgttctcctcgttcacctctaggaccttgctcacccttagcaccttgtggacccactggaccaactggacccgcagggccagtttcgcctttttctcctcgctcacccttaggtcccggagtacccgctattcctggcagtccttgttctcctcgttcacctctttgcccagtctctccttttggacctactggtcctgctttaccagggtcacctttctcgcctttttctcccctagcaccagcaggacccgcaggacctgcttcaccccgagcccctgctacacccgcaggacctgcagggccctgaggacctgcgggacccattgcacctgtttgaccctgcggacctattggacctatcggacctgcttcacctcttagtccccgctcgccacgatctcctttttcaccttttgggatgatgctatgcgaaccatctgtataggtaatttttagatcgccatttggttcatttcccgtactctcaattaacttacctttagtagcaatggtgatattgccattctcttgggttagttgaatgttattgcctgcagtaaatttcactgtatcacccattttgataagatgtgctgtaggaagaggagtagcttcaccacccgttcccttagcgatcgtcagtttccagcctgcatcatttacagcattgactacagtatcaacagttgcaagtcctgccgtctttgttaacaatctgccatcagttgtagagttaaactcaccttgagtcagtttaagggtaatttttgtattgccatttccctggtcaactgccgtactaataccaccagaccctacaattgagagcgtttcagtagaaagtgttgtgtgacccttcgtatcttcatcgccactgatctttaaagtcagtgcttttaattgtgctacgtttgctgcgtcagtatcttgtgtacctgcagcaacaccggtaatttgacgagtgacggtggtatcattacctactgctaccgctgcatgcgtagcagataatgtatttccgttaatagtataatttgtatcacttggtatccaacccgtttgccctgaatcacgactagtcttggattgataacctagagcaacgccatatttcgtatctgctatggcattattccccaatgctgttgcacgctctgcggttgcttttgcgttttcaccgaatgcggaagctcctacttgacttgcagtagcacttttaccaaaagcaatggcgtagcttccagcatttgcattaccaccaaccgcaataccgtaatcagcggtagacttactactcgcaccgatagcaatgccttcaacattacttgcatatgctataggacctacaacaatagatccttcgcccacagccacagacatacccccaatagcaatagaggctttaccaatcgtagttgttgttctggaatagttactattttgatatttcgttgtatttaaatcatctccaccgattgatatggagccatacccctccgctttgacatctgccccgatagcaatagattgtgacttacttgcactagcaaggttacctattgcaattgcttgttcacctgtcgcacgggccccttcgcctaagatagcagttctcccttccgcttctgaactactcccgatggcaattaatactagacttaaaagacttaatttaaatttatcttgctgtttatctaaaaataatgtgaggtgcatatttgatctcttttatacgtgttaagcgggggaatctcaaaaatacctgcccccactccattgtaaaaaaaaaaaaaaaaaaacaacatttacataaaataaagaataaaataacaagaatttttcaacttttattgtcaattattaaaaaagttagaaataataggcgggaaatctgatgaaagcggtgatttagatgggatattttacaccgcatcgtctcttgaacaggctgctatttaatcattatcacatagcctacttaacattgtcgtctaatcccaaatgcaacggacggtggataggatgttaaagaatcgtcttgatgatttagccacttttcaatccattttcctgttttacaatcgtcgttggctcttggtggataatcacttccgaatgaggaaagactgccagtattttctgttcaaggctgtcggtaatatcgtgtgcgataaccaaaggcagatgatcgtccagttctaaatgtagctgaataaagcgaatcgcccctgctctgcgagttttgacatcgtgtatgccgataatgcgagggtgttgcaaagcaatcgcccaaatttgatcgacttcttcttggggtaaggctttatccaacaaggattgcaccgcttcccagcacattttggcagcattaaacagaatataaagggcaatgccaatagcaaatacggcatcggcataaaccacgccgtagatatttaaaatcattgccacaagaattgtcgcattcatatagagatccgtctgataatgtaacgaatcggcttcaatcgctgggctttgggtgagctttaccacttttttctgataccaaactaatgctgcagtgagaacaatggagaacaagctaatcgcaacgcctaattcactgctttgtactaattgtggttcggttaaacgttgaataccttgtagcaataagaatgttgcagaaccagtgataaaggcactttgagcaagggcggcaagggattccgctttaccgtgtccgaaagtatgatcatcatcggccggctgtaaagcaaaacgtaacacgagcatattggttaaagaggcgaacaaatccactaacgagtccgtcatcgccgctaaaatcgccatcgatcctgtctgccaccacgcaaacgcctttgcaataattaaggtggcagcgacaattactgcaaagttcgccgcccgttttacatattggttatactgtttttccattatttgcactcaatttgccacgctaattgcgaaaactgccacgccatttgttgaagctctttaatataagcggttggattttgcaaattttttgcagaaactaaccgcttgtctgagaactgcatttggctgtagccacactgagaatttcgtccacgagtgacttctagctgataatcattgaaacgctctgtcggtggataaagcacttggctttgtagctcgtcaccaacaatcgctactttcgctttggtatcaggctgtttagcgaaggtttgctgacgtaactctaccctatcagcaagacttttttgttggctgtttttatcggtaaacaacaatatgccttgttgccagttattcggatctttcgagctttctttgagtaaaaaaagagattgttgcatttcatcaagctgattttgggtcactttttggtaggttttaccttgaaaattgacctgttcaggtatcgaaaattgcggtggtgttaccacgcagcccgttaaaaatagcggtaaaaaaaaggattttcgtaacattgtcacgctattgttcctcatatgtaaaatagactttagttaaagtattccaataaaacttttcattattctttttattcattaaagaattaatatcttctttctctttcatctctcgtaaataaaactaatgttttattatacaaaaactgataataatagtcgtaagctaacacattttgcacatatccccttgtttctacaaaaggaatggaagcaataaattcgtccatcgccaaagtgccgtttgcacgttctaaccaacggctcactcggtgaggccctgcgttatatgccgccgcaattaaaattcggttatttgggtaggtttcatttaactctgctaaatgggctgtccccaacataatgtttttaaaagggtcgagtaaatctttttcccctgtatagctcagttgatttgctttggctgtttggcttgctgtggttggcaataactgcattaaccctattgcatttgcgtgcgaacgtgcttgagcattccacgcactctcttggcgagcgattgccattgcaaaggttttagtgatttttttatgctgtaaattgagttcaaaccaatctgaataagcatttggcagacgtagcgataaataatcccacgcttttgcctgaatggttccttcaacggctaaatcaaaccaatcttgttgcaaagcaaagttactcaatgcaattttttcgtcaaaactcgccgcttgcagtaaatctacccaaacaattttggcagcactcagccgttttaacgcccttaactctgcaatgcggttaagctgaggcttaaatttaagggtttgttgttctgttaatttgttaatcgctggcaatacgagctgataaggctgtcctagggcttgagccgccaacataggataaaatcctcgctctgtggcaagttgctggaaaatagccgcttgttgtgccggctggcttttggctaaccaataacgccattccgctttggctctggtttctgggcttaatagcactaaccatctatttaaatcgcttttctgccagatcgccattcgtaagcggcgttcggttaaactatcctcttttaattcggctaactgtgcatctcgccactgctggaactggggtgttgtgttatcaaaaaagcgttgtagaaactggattttccattcacgcacttgattttcgctgagttgccactgctctgcccaaatttgatatggggcaaaatccacattttgcatttgttcaggcaaggttttgagaaatttggggaaagcgtgcaatacaagctgtttattgagatcgttaagcggttgtttcgcaataaaatgttgcaaataattcggttcagccaagagtttttgtaaatcggcaagccattttcctaactcgacatcttggttatttaacgctaactggcttaactccgcttttgcatttgttatccataatttgaccgctttttgtttcactttatcttcggtttttaacccctgatctcgccagaaggcttccaagttcgcacagtcagagggcaatgagccgttattgatccaaaaatcatcaaactttgctaacagctgagctaactcaggcgataaaggttgagcctgattatttgcttgtgccgcttctggatttaactgtaatttatctgcttggctttgatattgaaccgcccacacccgacattgattagcaacgcttagctcaccaactttgtcgctataggctagaagctctgaccatttttgctgtttgtaccacatttctatcgggaactgttccagcttattgcgttttgcgatatgcggatattgcttgataaagtgcagaatttcttcttgcgaaatagcgttcaattttagtttagtatttaatatagcccattttatctcttcaatcagagggtaatcaagcaacattgcctctaaatgcaccactcgctcaaatatcgcattagaaaattttccctctcgttccatctctcgtaataaagtctcaagcagcaaaaaatttactctttgcttttccaattgacggtagatatgttgttgctcgttctgccattgtaattttagtttctctatttttggagatgactgagactgtgtagcccaagcagataaacacatcgccaaataaacaaataatatttttttccccataaactctcctagatactaaagcccaattagcaattaaaaaccgcttgaagtttatatcaacaagcggttaatttaattgaaagtttcacttcttattcatcaataatcactttcgcaatgtaatctaaattacgataatactgtgcataatcaataccatatcccaccacaaactcatcagggatagcaaagccaacccattctactggtacatccacttctcgacgagaaggcttatctaataaagtacaaatcgcaagtgaggaaggttcgcgcaaatttaaaatatcacgcactttgttaagggtaaaaccagtatcaataatatcttctacaattaatacatctttgccttgaatttcactatccaaatccttcaagattttcacatctctgctcgattctgtacttaatccataacttgatgccgttaaaaaatcgacctcgacaggtaaatttaacttacgcaccaaatcagccataaacataaaagatcctctcaacagtccaacaacaaccagactctggctatttttatgttggtaatgttgattaatctgttctgctaactcagtaatgcggttttgaacttcttgagaagatatcatagtttcaatgtgatgttttttcataaacaaaccttttatctatatactatttaaaaatacaatatgatgtatcaaatgctattatacctcaatattctttgattaaataaaactacccattctccttttaagattaatcaacatttaaatgtgttcactacatcatttcatctacatggccatctatgaatttaggtaaatcagcaacactatcaataacataatcagcgtttaattcaccttcaggtgtaattagtttacctgtccgaaccaatattttcactttcaccccagcgttctttgcagctaatatgtcctctaatttatctcctaccatgatagattttgaagggtcaatatccagatcagaaatagcttgtagcaataaaccagcttttggcttacgacaatcacaagcctttttataattaccaattccttcaggatgatgaggacaataataaataccgtccaataccacaccatagtcttcatctaatgaccaatccatccattctgtcaattgatgaaattgtgcttcactaaaatagcctctagcaattccagattggttagtcactatcactagcatatatcctttatcttgtaattgctttaatgcatggccaacacctttaataaacctgaaatcatcaatattatgtacatagccatgatcaatattaattgtaccatctcgatccagaaaaatagctttattcgccatcactattgccttttaaaaagttaattaccaactggtgatgttcttttgttttaaatttattaaatacagacataattttgccatactcatccactaaaaaactaattcggtgaaccccatcataactttttcctaaaaattttttctttccccacacgccaaatgcttctgctaccttatgatccacatccgacaatagaataaagttcaaactattcttctcaagaaattttgctagcttttctggcgaatcaggactaatgcccagaaccatcacatttaaagaatcaagttcttccttgctatcacgtaaaccacatgcttgtgatgtacaacctggtgttaatgctttaggataaaaataaattagaaattttttgtttggaaattgctctagagttacccaattaaaattttgatctaatagagagaatgatggtacagtatcgcccacccttaatgtatccattattattccttttagctcattatagagacaataagtatatcatattctaaatatgcactaaaatattaagcataggaagattttcacaattcgattttgaataaaaatttgtgatctatgtcgtaaaatttaacttttcctattgcacattttacatatctgactaaaatttacatcataatctaactaagggagaaacattattatggaagttggtattgtaaaatggtttaacaacgccaaaggattcggatttatcacttcggactcatatgaaggtgatatttttgctcacttttcagttattgaaggagaaggctaccgctctttaaaaatgggacaaaaagttcattttgagttcactcatggagataagggagcttcagctgtacgcattgtgccaattactgaataatttcttaggggctactttagcccctaatttgttacccttaataaagactttggcataatagacaaaaaatagtaattaaaaccttaacaggtagacagtacccgtcttttgaatcctcttaatgcttgtttaaaatagcctcaatcccaataagattatttttcttccctactaaaattacaagacatcttcccaaattcatcaaaatacgtcgggaaagtttttgcggtacatttcggatctaaaatcgtcagtggcgtatttgacaacgccaccaaagagaaacacatcgccatacggtgatcgttataggtttcgatctcagcgtgttggaacttatctaacgcaagcggttgaatacgaataaaatcttccccttcttccacttccgccccaactttacgcaactctgttgccattgctgtcaagcgatctgtttccttcacacgccagttataaatattacgaataacggtttcaccctcagcaaaaagagcggtagttgcaatcgtcattgccgcatcaggaatatggttcatatccatatcaatgcctttaagctccccctgctctgcttggataaaatcttcgccccaagtgattttcgcgcccattttctcaagcacatccgcaaacaagcggtcgccttgaatggaatttttaccaatccccgtcactttcactttccccttaattgcccctgcggctaagaaataagaggcagaggacgcatcgccctcaaccaaatatttttgcggagaaacataatgctgattacctttaacaaagaaagtttggtaattattatgcgacactgtcacgccaaaatccttcatcatagcaagggtaatatcaatataaggcttggagaccaactcaccgacaatctcaatttccatatctccggaggcaaggggtgcggacatcaaaagtgcggtcaaaaattgcgaagaaatcgaaccatcaatctgaattttgccgccttgaatacccaaattacgaatagcaatcggcggatagccttcattttcaagatattgcacggaagcccccgcttgcaataacgcatcaaccaaatgtttaatcggacgctctttcatacgcggctcgcccgttaaaatcacctcagcctcttgctcacctttcaaacaaagtgccgctgttaaaggacgcattgcggtgccggcattacctaaaaacagcgacaaaccattttgccacttaaacgcaccgcccacgccctcaacggtacaaatggttttattatcagaaagctgataattcacccccaaagctttcaaggcattgagcatatggcgaatatcatcgctatccaataaattcgttacttgcgttgtcccctgtgccaaggctgccaacaacaacgcacggtttgaaaggctttttgaacccggtaaattaatttcgccctcaacacgagcgataggatttagtgttaatttttccataatgaaatcctaataattaaatagtttttataatatctaaaaaaacaacctcttagaattcattaagaggttgtaatccagaatatactcccctaccccgtattacgcatacctgccgcaatacctgtgatagtaatcatcaacgcttgctctaaggctggatttggattttcgccctcagcacgtaagcggtgaagcagctcaacttgaagtaagttaagtggatcggtgtaaacgttacgcagagcaatagattctgctacccaaggtaaatccgccattaattgcccttcgtgagcaagagagagaacgctgttgatgtccgctgcaagctgattgcgtaaggtatttcctaaacggtgtaaatattgtggtacaaggcgctgatcgtaatgttctgcaagccataaatccgctttactaaagaccatctctaacattccgatacgggttgagaagaacggccattcggtacacatttcttttaatagtgcttcattaccttgttcgatcaactgttgtaaggcttgaccagcccccaaccacgcaggcaacatcaagcggttttgcatccacgcaaagatccacggaattgcacgcaaactttctacgccaccatttggattacgttttgcagggcgtgagcctagtggtaattttgaaagctcttgttcaggcgttgctgcacggaaatacggcacaaaatcaggttcgccacgcacaatgccacgataaatgtcacaagaaatttccgagcctttatccattacatctcgccattcttgtttaggttctggcggcgggcaaaggttggcttctaaaatcgcactagcgtataagtctagacttgatacagcaacggcaggtaaacccagtttaaagcggatcatttccccttgttctgtgacacgcaagccatttttgagtgagcgaggcggttgtgaaagtaacgccgcgtgagctggcgcaccaccacggccaatagtaccgccacgaccgtggaataaagttaattctacattgtatttctcagataaattcaccaacgcttcttgtgcacgatattgcgcccaagatgcagctaacataccagcatcttttgcagagtcagaatagccgatcattaccatctgtttgtcgttgatcacaccacgataccagccgatattgaatagatcggtcattactttctcgcaatgatcgaggtcgtctaatgtttcaaatagcggtgaaacaggaatggttgttttgcaacctgcttcttttaagagtaaatgaaccgctagtacatcagaggcttcacgcgccatagaaatcacataggcagagatcacgccttcaggctgttctgcaaccactttacaggtatctaaaatctctttcgtttcagggcttggtgtccagttggttgggacaagcggtcggcgagagcttaattcacgcacaaggaaagcttgtttatcatcttccgtccattgtgaataatcccctaaaccgatataacgtgtaatttccgcaatcgccatttcgtgacgagtactttcttgacgaatatctaaacgagataaacctaaaccaaaacaacgaatacggcgtaagcaatctaataagccaccgttagcgataatacgcattccgcattggtgtagtgattgataacagtcgtagagcggttcccaaagttgctcgtcatcggttaagatttcatcacggctaatggtaagcggtttatcttgcaagagttcatcataataagctaaggttttgataagtttggcacgcagatctttcaccaccacacgatatggctctaaatgatcgccatattttgcacggaaggcatctgttgcgtgaataacagaaagctcgtcggctaatgatttaatatcttcaaggaaaagctcggctgctttataatggttcatacgcaacactttgcgtgtcgtttctgcggtaacaaacgggttaccatcacggtcaccgcccatccaagaagaaaaacgcacaggtgcaagcccaacagggtactgaacaccaaagtttttctctaaatggaaatttaattgacgacaaaattcaggtaccgctttccaaaggctattttcaattaccgccataccccattttgcttcatcaacaggggtcgggcgttgagtacggatttcattggtatgccaagctaacgcaattaattgcatcaaacgacgtttaagttttgtggtttctgcatcggttaaatcatcgtgttccaagcggcttaaacagcgattaatttcaacgtgtttatgcactaaagaacggcgagtaacttctgttgggtgagcggttagcactaaatcaatcaacagtttttcaacggtcgcaattactttttcagcaggcacattttgcgcttttaagcgagtaaataaagcacccatagagcgttcacctaacgctgcatctttattgtgacgagaaatcgtgtgatattgctctgcaatgttcgttaagtttaaaaattggctaaaggcacgagcaacagggataacatcttcgtttgaaatattggcaagaatatcaagaagttgctcacgtgatttttcatcacctgaacgtgatgcacgagacaatatacgaatattttcaattaaatctaaaatttcattcccttgggcatcgcgaatcgtttcgcccaaaaaatctcccaacatatgaatattactacgcatggattcataaatttggctcataaaatgtcctcttttcgataaaaattaactgggtgtagatataccgaaaaagagagcaaatggcaatggtatttagttttttttatgaaataaataagaaaattttatttttactcaatttttactttaatagcataataataaatttaataaggtgcttttagctaaaatcaatcgtcaaattaactgcttgtaaatacctagcctcatcaagcaagtccgccaatatcaaaggattctgcgccaagaatactttatcaaaggataaatgccacgatgaattttggatagataaattaagttccattggaatattcgttgcctgacgtgaacgatttagtaacactgccaagcggaatatgcgtaatagggttaaaatatcagggtgctgaaagcgacttgcaattttgagatcgtgtcgtttaaatcctttgaggtgataacgcattaatgtggctaacacagtttgttgttcagaatcaaaacctggtaaatctcggtttgcaataatatacgcagaatggcggtgaacaccgttgtggttaattgaaataccgacttcgtgcaataaacttgcccattgtaagatttctcgtaattcctgtatttgacgtttatttttccaagcggtcacttgatcaaacaaacgtaatgcggtgtcttttatgcgttctgcttgatgttgatcgatattaaattgttctgcgagggcttttgctgtccgttgtcgaatatctccaacttggaatccgctctcaacaccatataagattccttcacgcaatgccccatcggaatatcgcattgattgaatatggaaggtgtgaaataacgccagtaaaatggcaagccctggcactaagacatcggcacgctcttccaataatcctttgagctgaatttctttgagtgaatgaaatactaaacaacgatcaattaaggtttgtaaacgtgcttctgtaattaatccatctcgatagccatttgcaatcaacaccttgctcacggttttaattgttcctgaagagcctagaacgtgttgccaacctaactcacgatattcccacgccaaatcatcgattttttccatcgctgtttgatatgcctgttcaaaacgtgcttgagttagttcaccagcagggaaaaaacgttttgcaaaactcacacagcccatatggcgactttctgctcgtaatggagtgaagccatcccctatcgtcatttctgtcgaaccaccaccaatatcaaccacaaatttacgctctttttctggttgtgtatgacttacccctgaatagattaagcgtgcttcttcttgccctgagataattttaatcggaaatgggaatacttgttgtgcttgtgttaaaaaatcttgattgtttaatgccctgcgtaatgtgtaagttcctacgactttcacattttcaggcgagaacccttttaaacgttcagcaaagagtgctaaacaagcaacgcctctgtctatagcttcttgatttaagtggcgatgctcgtccaatccttctgctaaacgtacacgacgtttaatacgagaaaggatttggattgagccattaacaatccttgcaacaatcatatgaaaactgtttgagcctaaatcaatcgcagcaaattcgcgtgaaggcattttcgacataaagcaccccaaatagaataattcaaagcaaagtgtatcactttttcattcaaaatcgtggtactgaacaattattttttcattttttaagttatatacccattattaatttgaggttattgatccgtttttgtctttttgttacattatcccattatttttttatggctttaaaaggagaggtaatgatcaacaacagcacaacagcacaacagcacaacagcatttagcttagcatttagcttattactatgctgcttaggtattaatgcagagcagcttgaacttgatgaaatttctgtaatgggaaaagttcctgagggaaattcgataagttttctaaaagtaagtgatgctattattgatggagagaaattcaaaaatcgttctgcaacattagggaatgctctatctagtgaattaggcgtacatagcaccccatttggaggtggagcaagcgccccaattattcgagggcaagaaggtgttcgagttaagattttgcaaaataatgctgatgttgttgatatgtcaaatatttctcccgatcacgctatcactgcagatactctacttgctaatcaagtagaaattttacgcggtgcttcaacattgctttatgcaagtagctctcccgctggaattgtgaatatcgttgatcaacgtattccaaataaaatgcctaaaaaaggttatgaagtgacactttccagtcgatttgatacggcaagcaaagagaaagtgtatgcactaggtacaaccattggaattgggaaacatttagctttacgacttgaagggttagatcgtcaatcgcaaaattataaagtgccacaaattaaactaggtgaaacattaaattatgtgccagatacttatcatcaatcaaaagtaggaactattggtttatcttttattggtgaaaaaggttatctcggagcgtcttataatcagcgtaaagacagatatggattacctgggcataatcataaatttgatacttgtattgcccatatttacgatatgagattgcaaggaaagcattcttataccaatctttatccccatttaatgagtgatgaaatggtcacagaaaatcctcactttcattgtggtacagactacgatctcgatccaagccatagccacgatcacccttatggacacgaccacgatcatacccatattggaccttgggtagatttacactctaaacgaattgatataaagggagagattaaacaacctttgccgatgttggataaaattcagctaagttatgctcaaacagattactatcacgatgaaaaagacgcaggaaaatcaggcgatacaatcaacccaaaccgagtagataagagcaaagattttggtaaacccgtcaatattttcaaaaatcaaggcaaaaatgcccgcttggagttttttcatacgccaattggtggcttaactggaatgtttggcgtacagtatcaaaccctgcaaagcagcgctaatacaccaaacaaccgtgaagttcaatggcctttagtggataatcgcaacaagcaaattagcttatttgctttggaacaatacgcttgggataactttgcgattgaattaggattgcgaactgaaaagcagaatattcatattgactatgatttagctaagattcaaaaacaacaaaaattcaatgagaggacttatggtaaacaggttgatcctgatttatctgattatgatgaaaaagccatctcctatactggggcatttaattggtttttccacccagactatcagctctcgtttacagcttcccataatgaacgtttaccaactccgatggagctttattatcacggacaacatttggcaacaaactcgtttgaatatggaaacaaagatctaaaaaaagagatttccaataattttgaattaggtttgggctaccatacagaaaaattagattacaaattatcaacctattacaataattttgataattatatctacaatgaaacattatatcgctctaataacctctttatgcgccgttataatcaagctaaagccacattttatggacttgaaggcattattaactaccgttttacgcctgattatcaattcagtgtatttggcgatatggtaaaaggaaaattaaaacagctacccgacataaaaggattaaatgatgtctatggagagccaattcttaatcctgattacgatcctgaatatgatgaaccagaagaccaatactatcgtccttacttaggcaaagagatgattaaacaggcagatcgtgtttcgccacgtctaccgcctatacgtttaggggcaagatttaacgcacaattgacagaaaacctctcaggttcagttgaatggatgaaagtctttacacaaaataaagtctccaaattagaaagttcaacaaaaggctatcaattactcaatgcgagtttaaattaccgcagacaaataaaaggtgtggaatataccgttagtttgacgggaaataacttgttaaatcaaaccgtttacattcacaactcttatcacccctatgtaccacaaataggcagaaattttatcttaggcttagatcttagtttctaaaacctaacattatgtagcacttacataaattataacttttcgtagggactggggttatccccaccctacacaacactagtttttagctgccacataatatcgtattctttaaaggggatttaaccgcttgttttactagtcttacaaggaaaatttctctataatcgaccgtctgcgataaatctaacgatttttctacaaaatcttgagcaaaattttaaaaggtataaatatgtctaaatttccaacaatttcagagattctttctggcaaagttgccgtaggggaagaagttgctgtacgtggttgggtacgcactcgtcgcgactcaaaagctggtttatcatttttagccgtgtatgacggttcttgtttcgatcctatccaagccattatcaataacgatttaagtaattatcaagatgaagtattacgtttaactgcaggctgttctgtgattgtgactggtgtgattgtagaatcaccagctgaaggacaagcggttgaattacaagcaaaatctgttgaagtcgtgggttgggttgaagatcctgatacttatccgatggcagcaaaacgccactctatcgaatacctacgcgaagtggctcacttacgcccacgcacaaatttaatcggtgcggtagcacgtgtacgtcactgtttagcacaagccattcaccgcttcttccacgagcaaggtttctattgggttgcaacaccgttaatcaccgcttcagatacagaaggtgcaggtgaaatgttccgtgtttctactttagatttggaaaatttaccacgtggtgaagatggcaaagtcgatttcagccaagatttctttggtcgcgaatctttcttaaccgtatccggtcagttaaacggcgaaacctatgcctgtgcattaagcaaagtttatacgttcggtccaacattccgtgcagaaaactcaaacaccacccgtcacttagcagagttttggatggttgagcctgaatttgcgtttgcaactttagcagataacgcaaaactggctgaagatatgttgaaatatgtgttccgtgcagtgcttgaagaacgtaaagatgacttaaaattcttcgaaaaacacgttgataacacggtaatcagccgtttagagaactttattaattcagacttcgctcaaattgattataccgatgcgattgaagtgttattaaaatcaggtaaaaacttcgagttcccagttgaatggggtattgacctctcttctgaacacgaacgtttccttgcagaagaatatttcaaatcaccagtagttgtgaaaaactatccaaaagacattaaagcgttctatatgcgtttaaatgatgatggtaaaaccgttgccgcaatggacgtattagcgccaggaatcggtgagatcattggtggttcacaacgtgaagagcgtttagaggtgttagataaacgtatggttgaaatgggcttaaacccagaagattactggtggtatcgtgatttacgccgttatggtacagtgccacactcaggcttcggtttaggctttgagcgtttaatcgtatatgtaactggtttacaaaatattcgtgaagtgattccattcccacgcgcaccgcgtaatgcgaatttctaattggggaaaataggtaaacaaggcgagagagtatctcgccttattgtttaaaccttgaatgataaggctttaagcccgtttttagcaataaatttgtctactgtgccaatttgtctattacaccaattttagtaagttatttaggaagagatttataaatgttctgtcttattaaattcgattaattctcgcttttccccttcaacgcttatgatactcagggctgtgttctgtacaaaagtgtgctgttctggatcacggaaatgatgccagtggatcccttttaatacggctgtaagcagtgttaatgtcattccgtgcgacacaatcaggacattttccccctcttgatgtcgagcaatgatctgctctaatgcctgagtaaccctttgatagagctgttcaaaggtttccccttgactttcaatcgcttgataaagatgtggggcggtttttaataggatatattcggggtgttccgccagatcggcaactttctgcccttcccataaaccaaaactaaattcatttaaacctcgatgatgaaaatggggaatatctctttctccaataatatagtcagctgtatcttgggcgcgtttcatcaagctagaataacaagccgtaaagggaatatccgccaatgcggttcctgttttctttgctcctaaaatgccttcttcaaccaaaggcgagtcgccagtcccttgtaaacgcccttcaatgttccactctgttcgaccgtgacgcactaaataaatgtgtaatgccatttgctttctttccaataaaggttaaagtatcttttttaatggaaagagtataacaaaaaatgatgaactttaccgtctgctatcaacatcaagactttattattattgataaacctgcagggattagcgttcataaggacgatcaagcggaaggattaacgcaacaacttgccaaacagcttggtgtagaacaagtgtggctggttcatcgtcttgataaagtcacctcaggcttactgatccttgccctaaacccaacaagtgcaagttattttggcgagctttttgctcaacaccaaatccaaaaaacctattgggcattagcaacagcaaaaccgaaaaagaaacaaggcaaaattgtcggtgatatggcaaaaagccgaaatggaagctggaaattatgccactccacagaaaatcctgcgattacccattttcactctatatcgattgcccctcatttacgccaatttatcctccagccgaaaacgggaaaaactcaccaactgcgtgtggcaatgaaaagtctgggtagccccattcttggcgacgagctttatggtggtgaaaaagccgatagagtttatttacacgcctatcagctcgatttttattaccattcacaacctattagcgtttgtgtcttaccaagcggtcagttttggcaaaaacaagacaatcaataatactcatcttgcagttcatcaaaggcggatccttcctcaaaaagttgctccaaaaaggtagccactttttgttttccctctttgcctagcccaaaaacagcaagatcactattagataccgaaggtcgaactcgaacaatcgtatttggaaatgctttttcgacttgctctgccacaatgtctaaaagtctgttgaatttaccttgatccattttttgtaagttggctaaacgaatatcaatggttgcttgcataacattttcctcatctgactactgtatataaaaacattatatataaaaccagtttaactgtaaatagatacagatatttgttttggatcaaattttgacagaacgctaatgggtatattaagaaaagtttcctgataaaccgctattttttgatatttatcaaaaaacatttgcttacttattcttacaatgtttaccattaaataacaaaacaattacttttgatgttcaactataacaaaatgagggattaaaaatgaaaaaaacagcgttagccgtgttattaggaagtgcattattagcaggttcagccgtggcacacgaagcaggtagctttattgttcgtgcagggggcgtttttgttaatgcaaactctagctcaaaaacaacaactccagttgaggttaaattatacccttttcttcggtgctaaagctcttaatcctgcaattaccaatttacaagtgaaaaaacactcatttggtcctgttgctaatgctggtattgatattaaactcaccgagaaagtatcattaaacacagcaatgtggtacacccgtattaaaacaaaagcaaattttgatgctttaggtttatcacacgaagtaaaaatcaaacttgatcctatcgtttacttcactggtatttcatacaaattctaagaaaatcccatttcttacaaataaaataggcttccatcggaagcctattttttttaagtggtacgccacaaatttgtctactatgccttctaaatcagcaccttcctcaacgccataaaaaatctattattttcctctggcaacccgatactcacacgcaaatggtttggcataccatagcctgcaatcggacgaacaatcaccccttcgtgcaacaacgcctgataaatcggctgtgcaggctgttttaaatctaccgtaataaaattacctttcgatggaatatagtccaactgatttgccttaaaaaacgcctcataacgctgcatttcattacgattattttctgccactttcgcaataaaatcatcatcttgcatcaccgcaattgctgccgctaacgcaagactattacagttaaacggctgacgcacacgatttaataaatccgcaatttcagggtgcgaaaccgcataaccaatacgcaaaccagccaaaccataggctttagacaaggaacgagaaacgatcaaattcggatatttctgcactaacgcaaaagaatttaatcgctcagcaggatcggtaaattccgtataagcctcgtccaacaccacaatcacatttacaggcactctatctaaaaagtgttcaatttcctgttgcgataaaaaattccctgtcggattatttggattcgcgatataaatcaacttggttttgtcattaatcgcctgctcaaaggctctcaaatcgtgtccccaatcttttgcaggaatttcacgcgctaccgcattaatcgctttagtcacaagcggatagacaataaaggcatattgcgaataaataatctcatctttatcactggcaaacgtatgggcaaacagctcaagcagatcatttgagccatttcctaaggtaatttgattaggctgaaccccaaactttttctcaatggtcgctttcagctcaaaaccattggcatcaggatagcgagttaaatcattcaactgctttaaaatcgcttgtttcgcactttcaggaaaaccaaaggggttttcattcgaggcaagtttcacaatatttgaaatcccaagctcacgctcaagttcttcaatcggcttacctgcttgataaggggcaagggttttcacgccctcgttggcgatgttgataaattgcattgttgttccttttttcttgatgtttcgttgcagtttataccgtcgtcaattcatccgcaatcacttccgcttgttccaacacaaattggattgcctcatcgcatttatctggtggatatttgaataatctcaacgttacacgcaccaagtttcgcattttggcacgcacggcttctttatattgccagtcaatagtggcggatttacgcagtttatcggtaatcgcttttgccaagtttttcaaggcatcatcgcccaattctcgcaccgcactttcattgcgggcaagggcatcgtaaaaggcaatttctgctggcgataaacccaatttctccccacgttgcaagcgttcggtaaattccttgctcatattcagcaactcttccaacacttgcataatggtgagattttggttgtggtattgatttaacgcctgtttcaaacgctcggcaaaatctttttgcaccgccaaattgcctgttcctttttcattgatttggctacgcaaataacgctccaccgccaacagccaaagctcttttgtttgactgtttttgattttctctaaaaactcttccgacaaaatattaatattcggctgttctcggttaagcaaatcaaacaggttaatcgcaccgcttgcgtccaccgccttattcaataatgccaccaactgcaactggcgttcttcgtttgaagcggttgaatttggctcacgttttgccaaaatcgcacgcaccgcatcataaaaggcaagctctttttgatattgctgaacatcgccgtctgcaccacataagctaaacccttttttcgccaaacgcaccgcttttaaaaacgcattgcgtcttggggttttctccgttttatccgcaaccatttgatgatctaaggctaaaatatggttcgccgccaacatcacttgctggaacaacgccagttcatcttcgattttcaaggcatcaaacagcttaaacgactgaccattcaccggtgtggcaaactgcccacgcacaacatcaatgtattccaacatctttgccttaatttcggcgatattgtgggtcatctgccctttgccgtgcgagcgagtatattgttctgtcgcctctcgaagttcgctggttagccccacataatccacaatcaaaccgccattatcacggcttttattgcggaacacacggttcacccgtgcaatcgcctgcattaaattatgccctttcatcggcttatcaatgtacatcgtattgcaacaaggggcatcaaaacccgttagccacatatcacgcacaatcacaattttcagcggatcgtcaggatctttaaaacggcgttccaacagctttttatcttgcgaagaatagatatgtttttgaatgtccgcaggatcgctcgccgccctcgtcatcacaatcttaatcgccccttcattcacatcatcgctatgccactctggacgaagtgcggtgattttttcgtacaatttcacacaaatctgacggctcatcgccaccaccattgccttgccgtcaattaaagcggtgcgttgttcaaaatgtttgacaaaatcttctgccaaacggctcaaacgcccctctgttcccattaatttttcacgcaaacggaagttgtagctactttcatcatcttcatcaattagcgtttgggcttcttgcaccacattatcaaactcggcactctgtgcaatcggaatttgtcgagcttcataaataatcggcactgtcgccccatcttccaccgcatcggtaatatcgtaaatcgacacatatttaccgaacacttcctgcgtatctttatcttcaagactaatcggcgtgccggtaaaaccaataaaagacgcatttggcaaagcatcacgcaaatgttttgcatagccgacacggtatgtccctgtgcgatttagctcgttgagtttcatactttggctaaaaccatattgcgaacggtgagcctcatcgctgatcacaataatattgtgtcgcgcgtttaacactgggtgagcctgctcgccctcttgcaaaccgaatttctgaatagtggtaaaaatcacaccgcctgtttcacgcttggcaagttcttcacgcaacgcctccctgccgtctgcctgcacaggttgctgacgaattaacgcctgaccgcctgaaaaggtggcataaagctgaccgtccaaatcattgcgatcggtaacgaccacaatagtcggattgcgtaactccgcttgcgacaacaatttgcccgcataaaacaacatcgacaacgacttgcccgaaccttgtgtatgccacatcaccccgattttgccattgccctgctcgctcgccgcccacagcgtacaatccaccgcttcattcacgccgtagaattgatgataagcggcaattttcttcaccaaacgaccgcttgaggtttgctcaaacacaataaaattttggatataatccaacaaactcacagggttaagcaaaccacgcaccaagccttccaactcgtgttcaaacgaaatccgttgcttgttcttctcgtccaccacacgccaaggggtaaaccgctccaaatctgccgtgagcgaaccgaccttcgccaaaataccatcgctgatcacaagggcttggttatacacaaacagatcgccgatttcctgcttatacgtctgcaactgattaaacgcctgtggcaaatccgcattctctttcaagggatttttcagctccaataccaccacaggcaagccattgatataacaaatcacatcagggcggcgattacccttccgccccaaaatcgtcagctggttcacgacatcaaagcggttcaggtttggctgttgaaaatcaatcaaacgggcaaattccaccttttgctcatcattttcccgatactccacccgaacgccctcacgcaaatagcgataggcttgctgattacgctccgttaaatctgtaatatccgttttgcacaccaacgccaccacttcgtccaccgtagcagacggcaactgcggatttaaccgctccaccgcctcacgcaacaccgaacgaaacaccacctcgtccgtccgcaaccgccaaggattttccccatcggcattgatggtcgaaccgtgcgtataatcccaacccaattcctgcaaaaatcgcaaacaggcttgttcaatggtgttttcgttgatgagcattgttttttccttttttgttgatatatcgtaggagcgaaacatctttcgccccaaatttatttcccccgcacgcaagcgtacggggttacgcatagttcagtggctccgccactggattatatcgggtggcaacaccacccaattatgcttaaccgattgcgacaaagtcgctgtcggggttgtaaaattttgtgaaaatactaccgcttgtaaaaatagcattttcgttggtatatcattgccccagcggggcaacacaatgcgtaaccgtaggcgtaagcctgcgggtttatctcccccgcacgcaagcgtacggggttacgcatagttcagtggctccaccactggattacatcgggtggcaacgccacccaattatgcttaaccgattgcgacaaagtcgctgtcggggttgtaaaattttgtgaaaatactaccgcttgtaaaaatagcattttcgttggtatatcattgccccagcggggcaacacaatgcgtaaccgtaggcgtaagcctgcgggtttatctcccccgcacgcaagcgtacggggttacgcatagttcagtggctccgccactgggttatatcgggtggcaacgctacccaattatgcttaaccgattgcgacaaagtcgctgtcgggtttgtaaaattttgtgaaaatactaccgcttgtaaaaatagcattttcgttggtatatcattgccccagcggggcaacacaatgcgtaaccgtaggcgtaagcctgcgggtttatctcccccgcacgcaagcgtacggggttacgcatagttcagtggctccgccactgggttacatcgggtggcaacgccacccaattatgcttaaccgattgcgacaaagtcgctgtcgggtttgtaaaattttgtgaaaatactaccgcttgtaaaaatagcattttcgttggtatatcattgccccagcggggcaacacaatgcgtaaccgtaggcgtaagcctgcgggtttatctcccccgcacgcaagcgtacggggttacgcatagttcagtggctccgccactgggttatatcgggtagcaacgctacccaattatgcttaaccgattgcgacaaagtcgctgtcggggttgcaaaaatttgtgggaatgttaccgcttgttattacaaagtatcttgcaatctttcatattcaatactttcgtattccaaaaattcttctttataggcttctatatcttgatcaaataatgctctcgaaaatgaaattatctttcccatattagattcatacacttcatctaaataatcattaaattcctgataatcttcataacgtattcgctctcctcgctgataatctcccgttacaatgtaaaaatgtaaaataaatcctaaaattgcatttgttgtatgagttacaaataaagcaagatcactacttactggcttatgtccaatatcttgaccgtgagatgcatagttacaatcatttcttatttcagcaatataatgtaaaacagaacctaatcgtttagataattcttttatgtgtctagcatcagggtgattatcaacatttaaatgagataatgttgttgaaaccaaatttggaaaattatcaggagtagacacacctttatcagttaaaattgttttacaaataccttcagataaagatttacataattcaacacttaatactggatttcggtatatattattttctatttcagaaatatgtccttgatatactgataaactgggtaatttatctattgagtttaacaaccatttcatcataaatggatttctccactcaacaacttcggtaataataaatctctaacattttctaataaaaagctattttttctttggtttaagatagaacataaaatatttttatacatttccgtgaagtaatttaatacaacatcacaaggaactattatttcataatctaatactcttgctttatctgtatgtggaattgatgttcctgttgtattagcttgaatatcttgctctttactgaacataaattgattaaataaagcccaatatttattttcacttagttccatttttgcaaatgttgagccaataacacctttatgtccgatcgctatttttccagatgcagccccatccatcaaaatcaacgtatcaaaaatatcgcaaacgattgatttatctatttgtgcatattctgtatattttcctgacaatgaagccattaaaatatgtggcaaaaatccgtcatctggttcagaagaaattaatttaggtttcttgcccttaacaattttagcaacctccccaactttcttactctcccacccccttggcacgccctcttcatcaaacccactcgggaatgcctctgcgatttcccatagttgttggtattgttcgggatttgccgtctgcaagcggtgtaattcttgcgtgtttttaccactgatcactgccattgctgcttgggtggcttgctccaaggtttgtccgcttgccagtgcgttggctttggcgtgaacggggtcataatcaataaaccagcttttaaaaatcgtttgggcgatttgttctagggtttggttgatttgggtgttgagttggatttttttatctaaatcagataatttattcgcaatctctttttgtatatttaatggtggtaaatcaaacgaatattttgataaatcaccaattttcatatttaattgaacagatgttcccccagaaataccatcaatataacttataaaagatttagacttaaatacataatatacatatgtaggatatgcaatatctttttttaatctaattctagctaatccattattaaaaacagcaggaagatcttgtttagccaaaaaacatattcctgtagaacaagttctcgccattataatgtcgtctttcattaatctgaatttactataatctgtgttttttacttcagtaaatccccagctttcaatagacttattctgagaaatatcttgaattctcaaacatttaatatctgtttcaaaatcgactataggtgctctacgaatagcatctaacccagtatttatgctttcagaaatatcttctaaagtaactttcttccaactactcataccccaaccctcccaaattcgctttaatcttggcttctaattctgcactttgcttaaattgttgttgtaaaagtgcggtcagttcttgcattttttctgcaaatggtacgccgtcatcttcttgttcggcggcaccgacataacgccccggggtaaggacgaagtcgttttgggcaatttcgtcaaggtttgcggtgtagcagaatgcagggatattttggtagtcagcggattgttgccagttgtgataggtgtcggcgactttggcgatgtcgtctgcggtgaaatcgcgtaagacacgatctttcatatagccaagttggcgtgcgtcaataaacagcacttcgcctttgcgtgctttgtttttgttcaaaatccagatgcaggctgggatttgggtgttggtaaagagctggcttggcaaggcaatcatcgcttccacaaggtcggctttgagaatatttttgcggatttcgccttcgttgttggtgttcgatgacattgagccgttggcaagcaacaacgccattcgtccgtttggcgaaaggtggtaaatcatatgttgtagccacgcaaagttggcgttgccttcgggcggtatgccgtattgccagcgtgggtcttgggcaaggctttcgttccaccagtctttcatattgaacggtgggtttgccatcacaaaatccatttttttatcacggtgttgcggattgctgaaggtgtccgcgttgcctttgccgaagtcaaattcaatgccacggattgccatattcattgcggcaagtttccaagtggttgggttgaactcttgtccgaaaatgctcacttcgctgacgttgccttgatgttcgcggataaaacgttctgtttgcacaaaaaagccgcccgaccccattgctgggtcgtaaatgcgtcctttgtagggttcgagcatttcgataatcagggtaacaatggattttggcgtgaaatattgaccgccctttttgccttccgcaagggcgaattgcccgagaaaatactcataaacgtgaccaagaatatcttttgccgccaagtaaatcggcttgccgtcaagggttggacgggtgaagttggtgtcggaaaagagatcgattaagcctaataaaatgctttcatcaactttataagggctgatgcgttgaatgacgtttttgagtttagggttgtcttgttcgatagcatcaaaagcgtcatcaatcaagttggcaatgcctttaaaggttttctcgtcccagattttgtcgccaatgttagcacgagccacgactttgatttcgtcccaacgggcttgttgcggcacccagaatacgttgtcttgggcgtagttgtcccgttcttccagttcggcattgagaatatcggcaagttcgctttcgctgtaagcggtcgggtcgagataaaaatcggacgttggatcggtgtagcgttgtttgatgatgtcttgttgtgccgagaagctgtcggaaacgtattttaagaagattaaaccgagaacgatgtgtttgtagttggcagcgtcaagctgttggcgaagtttatcggcggctttccaaaggtcggcatcgagtttgttgagaaaggcttgttgatctgattgctgagtagctaaattttcagccagatgtgctgtgctgtgctgtgctgtgctgtgctgtgctgtgctgtgctgtgctgtgcattatactatatctccgtgagaaatttcaataaaaatcaataaattacactttgctatttggacacgatgcgtcgtgtccctacaaatacttcggattttatttttttcgaatatccctaattcaacgttattgtagggacgccacgcttggcgtccgttcaataggtcagattatttattttctgcctcaaacttctgcataaacgcaatcaacgcttgtacggcttcaatcggcattgcgttgtagattgatgcacgcataccgcctaatactttgtgaccttttaaggcttgtaaaccgctagcggttgcttctgccacaaattttgcattgagttcgtcgttgcctgtggtaaaggtgacattcattaaagagcggttcgctttggcgacggtgttgtggtagaaattgctgttatcaagataacgataaagcagttccgctttggcttgattgcgtttttcgacttcggctaatccgccgatattgagcaaatgcttgaataccaaagaacaaaggtaccacgcaaatgtcggcggtgtgttgatcatggagtcgttattggcttgggtttcgtaattccaaatagatggcgttgctttgcaagccttgccaatcaagtcttcacgcacaatcacaagggtaatccctgccggccctaaatttttttgcgcaccggcataaattaagccaaattgactgatgtcgattttgcgggaaagaatattggacgacatatctgcgaccagcaccgcattgcctactttcggcacatcaaaaatctctactccgctgatggtttcattcgggcagtaatgaacatagtcgtactgctctgcaatctcgctaaaatcaaggctacccaccttgagttcatcgccttgctctaaaatattgatttcatcaatttcacagaaattacgagcttctttcgccgctgtcgctgaccaatgtccgctagttaaataaagcgccttgcctttttcgccgattaagttcatcggaattgccgcaaattgccctcttgcaccaccttgtaggaataaaattttgtagttttcaggaatgttatagagcttacggaaattttgttcacactctgcgatcatttccataaacaatttaccacgatggctaacttccattactgaagtgtgttgattttgccaattcaacaattctgcttgtgctttttctaatacggcagtcggcatcatcgccgggcctgcactgaaattataaacttgtgtcattgtgtttgcctcttataaaaaatggtgctttgcattctagcggaaatatggggctgtcaaaaatttcaatttttatagcttctcacgtcgataatataaggtttctgatacttcaaaatcatagtatctgcggtcataaaaaagacattttctacttccgcctgagccattaatagacgatcaaagggatctcgatgaataaaaggatactgagcttgttttagaatatggggtaattcaatagctagcattcgacaacctacctgaattaagccttgctctaaggcttctacatcaatgtcaaaatcaggtttacctaaactagatttaatcgcaatttcccataaacttgctaaactaaaatagatttcactggtcgggtcatcaagtaattccaccgcttgtggcgataggttttcttttttatcccacgcaagccaaagcaaaatatggctgtctaataagatcttcattcctcttttccttcaaacattgccacaatttcattttgatacaagcggtcaaaatcttcaggaatttgcatattttgctttttcataaaaccaaagcgactgccattttgtatagtatccaaaggcacaattttaacctgtggtttacctgattttgcgatgatgatcggctttccaaaacgtttcacatcttcaacaatgcgagaaaaattggtttttgcttcgtgcatattcacactttctaaagattgatttagcataacagcccctttttcttagtccgataagtgagtctagtcttattttctagcttattcaagagattaattcgtcgcttcccccattaccgcctcaatctccgcaatctctttcggcacgcctgacgtaagatttttattgccgtattcggtgattaaaagattatcttcaattcgaataccaatgcctttatattgctctggaacatcggcatctttcgggatatataatccaggctcaacggtaagcaccataccgatttcaagcggtcgatctcgttcattgccatagtcgccgacatcgtggacatctaagcctagccaatgtcctaagccgtgcatataaaattgtcggtaggctttattctcaattaactcatcaacattgccttttaatatgcctaaacgtaccattccttctgtcataatacgcactgctttatcgttagccagttggatcgagctttgcggtacaagcagtttagtcgcttcttttaaggcttccaatacaatttcatacacctctttctgagccgtagaaaatttgccattaatgggaatagttcgggtgatgtcgcctgcatacattgcaaactctgcccctgcatcaattagcagtaaatcaccatcttttaacacttgatcgttctcattatagtgcaaaatgcacgcattattgccccctgcaataatttgattataggacgcaaagcgagagccaaaacgagaaaattcgtattgaatttctccttcgatttccatttcgtaacggtttgggcgagtttgtttcattgctcgtaaatgcccaaaggctgaaatttggcaggcttgttgtaataaggcaatttcggcttcagatttgaacaatcgcatttcagagagtatcggttgccaatcaatcaaagttgttggggcttttttacggcttgcagtgatggcatcaaaggttgcaaaaacaatctgatcgccccacgtttgcacatttcttgcatagtaacaagcggtcaaatctgtccatttttctgcaagaatggtttgaatatcttcgatatcgtaggcttgatcgacgtttaacgtctgtggtgcaacttcaatacctaaacggcgaccgttccacgtttccattagcggatcttttttgcgtaaaaaaatcaagctctcacactgccctgcttttttcagcaacactaacgctgatttaggttcagcaaatcccgtgagataccaaaaatagctatctggacggaataaatagtcgcagtcgttattacggcgtttttctgtttcggtaaagacaatcaaggttgagttgtcttgcatttgttcaaacaaacgctgacgacgagtgtgaaattcttcttgggggagtttttgtaaataagcgagatccataatcattccttaaaatcgatttttgaacgttacaagcatacctatcttcactaaaattgacaaatgctaatactattttccaactgttttaacagattaactcgactgaaatctcacattgcgcttgaaaaagctgttgattacaatccataaaacacccaaaatatactcataatagtagggacacactgcgtgtgtccgtaaataaaaaatgaaccatttaaagtgtccgtagggacgccacgcttggcgtctgtttcatttaaccttactttacaggcggacacactcagtgtgtccctacgatattgatatttgtaaaaattatattgacattggacgccaagcgtggcgtccctactatatcttttgtttaaatgctatacataacaacaggtaaaaccgtttctttcaatctttaattattttttaaaagctcgcaaatacgctttttaaggaaaacactatggcaactattcagcaatttttagacatcgttgagcgtttacgcgacaaagaaacaggctgtccttgggatattaaacagacctttgacacaatgctcccgaatctattggaagaaacctatgaagtggcggaggcaatttatactaaaaatcgtaccgctttgcgtgaagaattaggcgatctgttgctacaagtggtatttcttagtcaattagctaaagaagaaggaatctttagctttcaagatgttctaaacgatattcacgacaaattaatttatcgccacccacacgttttcggagataacgccgcaaccaacagtgaagaagctctacaaaactgggaagcacagaaagctaaagagaaagaagcaaaacagcaaacgtctatattagatgatctgccttttgctctgcctgcccttactcgtgcagacaaattgcagaagcgttgtgctaaagtcggttttgattgggataatccgcaagatgtacttgccaaagtagaagaagaactcaccgaagttcaagaagaaattcaacaacagcagcctgaaaaattggcggaagaattaggcgatttattatttgcaacggtcaatctatgccgtcaccacaaaattgactcagaaactgcacttcgcaatgcaaatgtaaaatttgaaaatcggtttaggaaaattgagaattatctgatttctcaagggaaaaaacctcaagattgcacattatccgaactagattttctgtggaatgaaataaaaaaagtggaataaattgacaagattaggtaaagtaatactatagatttgtttatgtaaagataatttatgtaaataatcaagaaatgatcaatggaatagggaaatagagctatgccaaaaattttacttgttgacgatgatgtagatttaactgaattactttcagaatcactctctcttgaaggctttgatattcatactgtacacaatggtcaagatgccttaactgaattagagatacagaactacgatctcattctacttgatgtcatgatgccaattcttaatggtattgaaaccttaaaacagattcgtcaaaaatactcaaccccagttctcatgttaagcgcaagagatgacgaaattgatcgtgtgcttggtttggaacttggtgcagatgattacctaccaaaaccatttaacgatagagagttggttgcacgtataaaagctatcttacgcagatcaatcacacagaaaccaagtatacctgttgaaacaacattcgttataaatgatgacgatgacagaaaattactacaatttggtggcgttgagcttcaccctggtctccagcaagcgatttatgaaggaaaagatttagatcttacaggaacagaatttgcactgttacaaattttaatgcgtaaccctggacaaattctctcacgcgaactgttaagccttgagattttaggtaaacgtttaacgccatacgatagagcgattgatatgcatatatctaatttgcgtaaaaaactccctgagcgtaatgataatctcccttggtttaaaaccttgcgtggtcgtggttatttactagtgactgaaaaataatcataacaaaataaagtccctcagcttgtgtatagttgggggatttttctatctataggttagccgttatgttaaaacttagaaatttccgaagatatttagcctatcaaatctttgcctcttttatggttaccattgccattattttggctcttgctattttactgccaagtttagatactcgtcgtttcaagcaaattgacgattttcaattaggctttttacagcacgaaaccaaatatgtagaacaagaatataatttagacgaagtgtttcgccacaatctctctgtagcatctattaatggttttgacattatcctctttgatcacgcctcacaacaattagcaggaataagagaggaaaataatgaagctttccacgcttttatatataaggcaaaaaatcaccgccaaccattacaaagacgcttcggcacaatggaattttacggtccttttcttgcaagttctcacactcgcacttacgacctctatttcactaaaaaagtgaaccctcaacgagagctcattaatacattatttgactcgccttggataatgctacttttgtttctttttgtcagtagcccagtgatgatctggctatcgtaccgcattgccaaaccagtaaaagaactgcgtttaaccgcaaatgcagtagcacgaggaaacttagccatcaatcccaaattagaaacctcaggcattgaagaactccgtcaagtaggcgcaagttttaatgaaatgattgtcgcattagaacgactaaccaactatcagcatcgtctcttatccgatatttcgcacgaattaaaaacccctttgactcgaatgcaattagctttatctctcttgcttcgtcgaaatggtgaaagcagtgaaattactcgtattgaaggtgaaattacaaaactggacacaatgattcacgatttattggttctatctcgtaaacaagctaatcaccatctagagcgagaagtctttccaatccataaaatatgggacgatgtattaaatgatgccaaatttgaattggaacaaagtggatttgatttagtcgtaagccaacgtatcctccaccctgagcgttactttgtaaatggcaatgttgtattgttagctagtgccgtcgaaaatgtcattcgcaacgccaaaaaatatgctcaaacaaccgtaaaagtgatgttttatattgataccagcgatctttatattcttgttgatgatgatggagaaggtgttccagaagatcaatatgaagaaatattccgtccgttctatcgtgttcaagaagacagagcaagacaaacggggggaacagggcttggtttatctattgttgccaatgcaatacgacaacatcacggttcagttagagcagaaaaaagcccattaggcggattacgcgtcaaaatgcaattgccgttgtgggtggaataatatcaatatattgtcaatatctttaaccttgttatgaaaatgtagatataatgtcgcactttattcaattttcaggtaaaacatgcgtttagataaatttatagcagaaaacactgggcttactcgctctcaggcaagtaaagctctacggacagggcaagtcactgttaatggtgtggttgaaaaaaatagtgcaaccaaaatcagtgagcaagatgagatctgttttgatggcgaaccgctagcttgggttgatgaagggcaatattttatgctgtataaaccacaaaattgtgtttgctctcacgatgatggcgactacccgacagtatttcaattttttgactatccacttaccacaaaattacattgtgcagggcgtttagatgctgacacaacaggcttagttttattaaccgatgacggacaatggtcacaccgcattacttcccccaaacatcattgtgaaaaaacctacttagttacccttgctgatcccgtggaagatttttatgccacgcaatttgccgaaggcattttattgcgtggtgaaaaaaccttaacaaaacctgctacccttgaaattttagatgattacaatgtcaatttaactatcagcgaagggcgttaccatcaagtcaaacgtatgtttgctgctcttggaaacaaagtggttgcattgcaccgctggcgaattggtaatgtggtgcttgatgaaactcttgctgaaggggaatttagagctttgactgaagacgaagtagcgagtttttaaatgaacaagataactaaaccaaatggattttttgtggtgattatgggattactctcaatgttgccaccgcttgcaattgatatgtatctgccatcttttctcgatattgctcaagatctgtcggtatctcaagaaaaggtgcaaacaactcttgcgatttttactttcggctttgcaattgggcaacttttttggggaccaattgccgatagtttcggacgtaaaccgattattttacttggcttatctggcggggctgtcgcagcttttttcttaacgcaagtattgagtattgaaaatttctatctattgcgtctattacaaggcttatttggagctgcacctgcagtggtacttggggctttagtacgagatatattcgatcgcaaccagtttgcccgattaatgtccaccattatgattattacgatgatcgcaccgcttgtagcgcctattttaggcggatatgtagcgaagtggctacattggcacgctattttttatattttaatggtgatggggattgtctgcgtttgtttagtagcaacgcttattcctgaaaccttgagtacagaaaatcgaatgccgttgagttttcgtcaagtactacaaaattttacgacattgatttcccataaagcaacgttaggatatgttctcgttggtggaatgtcctttgcaggaatgttttgctttcttacttctggctcgctggtttatattgggctttatggggtttcatctgaatactttggctacttttttatgctaaatatagctgtgatgatggtgatgacctttatcaacggacgacttgtcaccaaaatcggctcagaaaaaatgttacgcattggaatgagcttacaactcctagcgggtatttggctgattatttctgcgacattgcaattaggcttatggtcaatggcaattggcgtagcattttttgtaggaatggtttcgaccattggtagtaatgcttcagcggcaattttagatcgctatccacaaatggcaggtaccgccaatgccgtagctggtactgctcgctttgggattggttcattagttggggcaggattatcccatattccgctaaccagcgagcgtccaatgctctatacgatggcggcttgtacgatagttggatttattgcctattattttctctcttgtagaaatcagcaacttcagtgacttttgcctattaattcataaaacagataatcttttttcgattgataaaaattctaataaatccaaagcattaaatcttaaaaccataaaaacaagaagatttagcataatatgctaacatatcacttaatatgccaacttaaaacctatttcacagaataaaaaaatgcaattttcccaaaaatagcattttacttttgttttgagtagcgatatattccaaatcattcttttacaagcggttggatttgtaagaagttttaacaagatgtagggacacactgcgtgtgtccacatgatatcggtaaacggacacacgcagtgtgtccccacgtttatgttccatattgaaatgttgtggtaattttttatgtgatccccccgcttgtccccttgcatttgagagttggacttatgaaaaaaaccttatacgaaaaattatttgatgctcacgttgttcacgaagctgaaggtgaaacacctctaatttatatcaatcgccatttggttcacgaagtgacttcaccgcaagcctttgacggtttgcgtgcgatggggcgtgaagtgcgtcagccgaccaaaacggttgcaacaatggatcataacgtacctaccgatagccgtgacttaggcggttctggcgaaatggggcgcatccaaatggttgagctggcaaaaaataccgagcagtttggcgtgaccctttatgacatcaaccatattaatcaaggtattgttcacgttatgggacctgagcagggtttaacccttccaggtatggccattgtgtgtggcgactctcatacggcgacacacggggcatttggtgcattggcgtttggtatcggtacatctgaagttgaacacgttcttgcaactcaaacggtaaaacaagcccgtgcgaaaaaaatgaaaattgaagtgcgtggcaaagtgcgtgaaggcattacggcgaaagatattgtgcttgccattatcggtaaaactacgatggctggcggtacaggacacgttgttgagttctgtggcgaagcgatccgtgatttatctatggaaggtcgtatgaccgtgtgtaatatggcgattgagcttggtgcaaaatcaggtttaattgcaccagatgaaaccacttttgcttatttaaaagatcgtccgtctgcaccaaaaggtaaggattgggacgatgcagtcgcttattggaaaaccttgcacacggacgaaggggcagaatttgatactgtggtcactttagaagccagtgagattgagccacaagtgacttggggaacaaacccaggacacgttatcggtatcaatgaaacgatcccgaaccctgcggatatggcagatccgattgagcgtcaatcggcggaaaaagccttagcttatatgggcttaccgcacagtattaaattgactgatgtggctatcgacaaagtgtttatcggttcttgcaccaactctcgtatcgaagacttacgtgcagcagccgccgtggcaaaaggacgcaaagtcgctgatggtgttcaagccttagtggtaccaggttcaggcttagtgcgtgaacaagcggaaaaagaaggtttagataaaatctttattgaagcaggctttgagtggcgacaaccaggttgctcaatgtgtttggcaatgaacaatgaccgtttagagccaggtgaacgctgtgcttcaaccagtaaccgtaactttgaaggccgtcaaggtcgtggcggacgtactcacctggttagccctgcaatggcggctgcggcagctgttcacggcaaattcgtcgatattcgcaacgtagaattacactaaggaataagaaaatggcaaaagaatttaaacaacatactggtttagcagttccacttgatgcttcgcacgttgataccgatgcaattattccaaagcaattcttacaaaaagtgacccgtgtcggctttggcgctcacttattccacgaatggcgtttcttagatgatgaaggtaaacagccaaatcctgatttcgtgctgaattttccacgttatcaaggggcaagcattttattggctcgtgaaaactttggttgcggatcttcccgtgaacacgcaccttgggcgttagatgattacggcattcgagccattatcgccccaagttttgctgatattttctatggtaacagtttaaacaaccaaatgttaccagtgcgtttaagcgaagaagaagttgatgaacttttcaaatatgtcgaagcaaatgaaggtgcgaccattaccgtcgatttagaagctcaaacggtttcggcaaatggaaaaacctactcttttgaaatcgacagtttccgtcgtcactgcttgttaaatggtttagacaatatcggtttaactttgcaacacgaagaaaaaattgcagcttacgaaagcaaaattcctgcgtttttgcgttagttgcagataagtttttctgtttaaaacgtctacaattattggtggcagttttgtctattacaccattttgtggggcatagtagacaagtttgtctactatgcctgtctctgctgagaatcagcttttacgaataattaaatgataagaacacgccgtgtttctacccattcaacaccccaatctctcgctcaatctgtgctaatgtattatcaatactcagatcttttaataaataatctttcaccgcatgcccaatgattgcttcaatttgacgcaaattcaccgcttgatcatttaatatattttcacgcacgccctgaaaatcgctctgttttgccaaagcaagccaaggaaaattttgggtaatacttgggttactcattaaatcttttcgtgcagacataccgcccaactgaatatattgctcttgaatggtattttgtaaaaaccaatggataaaatactcgcaagcggtctgtttttccgtctgttttaaaattgccaaagagccaccacctaataaaggacgagcattgggtacggtagtaaatccaatcggactattagaatgttcacttgaaagcggtgaaaagtggttcatatagacaattaacaacggaattttcctttgttcaaataattttacttcttctttccaccaacatttttctaataaaatcgaatgatgatataaagtttttagctgtgataaactctcaacaactgcttgactatttaaggcaattttccccttggcaaaaatagatgggcaaatagcgtaatatctaacaaaaaattcacttgccaatgtgccttcatcatcaataattaatgccgatcctttttcaatttgcggatattcatacagacctgattggaagaaaggtaataacttattaaattgctcaaaattggttggcaacaccaattcttgcttatatttttcataaaataaccgcttaattttaggatcttcaaataaatctttacgataaaaaagcatctgaaaacttggatcaaagggaatcgcataaattttttgttgaaattgacaaaaactctgaagaattttgcttgaaaaatagttcgataatgtttccaaagaaagaaactctaagggtaataaataagattgtgcaaaatagagtaaactttccatatcaattcgcaccatatcatatttatttgtcattttatttttttctaattctgttggaatatctgaaaatgcacaggtttcaatattcacctcaactcccgttaattttctaaaatggggaataagtttttttagtgcttcaatagaggggtttgaaatcgctaataaatttaattgtgtaggtaatacattatgattttcaaaggctaaaaaaccaaaatgatggggattatcgatattattttcttgctttatttttgctaaaagttgttggctaatataaccataatctaaactatattgaataaaacgattatcatcattaaaactattatgataaaaagtatatatttttggaagtggtttatctgaaaaataaaaggcattatggataagtttggcagtttcaaaagaagaaataaataatgctgaaatgttttcaatatgagccaactcaaaggcaagtaaatggctatttcctgtgggttcaataaattttaattgaatattggcttgagttgcttgtgtaattaaataatgataatccctttctctccaatcaacccattcatcttttacaaaaataacattatctaactgattttttccctgttttcaataaagtcatcaataactttggtataatcaaaatgaataaaggttttgccgtctaaaatttctcgataaataagcatttatctaacacgttaccatattcttttgcagttgttaaacaactgtctacaataacaaaaagataattttcttctttaatccgttttataatttcttgctctttttcttcctgattataagtgagataaagttcaaaaataaaattatcttgctgaaagtctgcattcagattttcatacaggctactatattttacatcaataatatttggcagaataatctcaattttattgcttacacctcgttttaactgagccgcttgcatattgcgttggtagactaatttttcaatcgcacgctgtactttttcaattttgtctaaacttacgccactcttgccatttagcacatttagaaaccgtacataaagaaccccctgcttctttagcaagatcttttatcgttacaatcattgtcgtaccttaaaactttactgctctatttttgccttatatacaaaaataactattaccatgaatcaagcacatgaaacatgtatttacattatgttaatcagttttctagtattatgtagctttgaaccaaagaaagaacagtaggaacgccacacttggtcttcctactgtataaaaagtttatgcatatattactacagcctgaagataattttcatcgttttattctcccgacactttcaatttttccaataaaattgaacctgtctgaatattcgaacgatgttcaatatcatcaccaacagcaacgatatttttaaacatctcttgtagctgtcctgcaatggtaatttctgcaacaggatattgtatttcgccattttcaacccaaaaacctgcagctccccgtgaatattctccagtcacgacattaatcgcactgcctaacatttcggtgacaagtaaacctgttcccatctctttaagtaatgcagttaatccccctgtgcgattaggtttgactagccagttgtgaataccgcctgcgtgtcctgtcgtttgcatacctaattttttagcactgtatgtcgttaaaagataggtctgtaatgcgccatctttaatgatttggtgatcgcgagtgtaaacgccttcgctatcaaaaggtgatgaagcaagttggcgaagtagatgcggtttttcgttaatttcaaaccaagtcggcaaaatttgctcacctaacttgtcttgtaagaagctggctttgcggtataaagctccgccactaattgcacctgcgaggtgtccgataagccctgtggcaatgtcgttataaaaaatcacaggaacttcacaggttgccagtttttgagggtttaggcgatcaacggctttgactgcagcttgttgcccaacccattttggcgaggcaagttggtcaaattgacgagagatagtgtattcgtaatctcgctctaactgatcttcataggctgaaatgacgctacaagagagggaatatcggctagataggtagctttgtagcataccgtgtgtgttgccataaactctaatgcctgcgtgtgaattgaaggttgccccttcgctattgacaatgcgatcatcgctgtgtagtgcataatgttccgcttcaatagccagttcaaccgcttgatcaacggtaatgtctgcttgatgatataacgccaaatcgggggcttggtatgccatcatttctttgtcagctaaacctgcacagtcgtcctctgaggtatattttgcaattgcaagtgccgattcaaccgcttgttgaatagattttggttgcaaatcggaagttgaagcattgccttttcgtttaccgagatagacagaaataccgagtgagccgtcgttgttaaattcaatattttctgtttgttctaagcgtgtagaaactgataagcctgcgactttggttacacccacttccgccgttgcacctgctttttgggctaaatccagtgcaatttcaacggcttgacgtaaggtttgttcttgagcttgaagttcttgtttggtaataaatgacataattttccttctataagcggtaggattagcgaaaatttttgtaaaactgttctcttttcacttaatctcgccattctaccctaaatttctgctaaactacgcaaattttgtaaaagaaaggaatagcaatggctagaaaacaacgtaatgagattgattggacagatgaggaagaagagatcatctgggtaagtaaaagtgaaattaaacgtgatgcggaacatcttaaaaaattaggggcaagtttgatagaactgaatagtgctaatcttgctaaaatgcctattgatgataccttgcgtgaagcaattgagttagcgcaacgcttacgtttagaagctcgtcgccgtcaaattcaatatatcggaaaattgctacgcaatgtcgatcacgaacctattcaggaagcattggataaagttgaaaatcgccataatcagcaacaagccctattgcacaaattagagttaattcgagatgaactcattgagcaaggcgacagtgcgatcaatccgcttgtagatgaatatccgacattggatcgtcagcatttacgcaatttaatccgtgccgcacagaaagagaagcaagcaaataaaccaccgaaaaattatcgtgaaatttttcaatatttaaaatctacaattattgaacaaaattaaataaggacaaaattaatgcaaacgatcttttatactcatattggtttagcttacctcagcttaatgctattactggttcgcggattactttccgcaagaatggttgattggcgacaatataaactcttaaaaattgcaccacacgctgttgatagcttgttattactgtctggtgtgggcatttttgtctatttcgccatggattttcaaacgtggattttagcgaagttattctttttggtgatgtatatttattatgcgacaaaagccttcaagaaagagcgacctttttctctcaaacatttcattcttgctgtcgtcagttttatgatggtgatgatggtagcaacagttaaataaacaataaggcatagtattactactatgccttatctttatagatgaataaaataacttctgtttctgactctattttgcttttgagctcgcactgaatttcttggcataataaaataatatcgtttaataaaacgtctttattcaaatgaagtttcaaactttctccgcttttcaactgtaacattcccctttttgccgacaaaagaggaagagggcaacggtaagcagtgagatcaagtgaataattcaccattaaacccgacggcgctctgccataatctgcccgattgagttgagttcttcttggcttagatgctctcgccctaattcaaaaagcggttcttcaatcgcaatatgttgatcgtaacctaccacaaagcgttggattaactcgcggtcaatgtgttgaatttcgccattgagtaaggcgactaattgggtggagagttcgtcccaatattgatgtaattcaatgtgttgtgcttcgagcaaatctacgtccgtttgcgcttctgggcgttgcttaatcaatgctgggaagaaatctttttcttcgtcatcgtggtgtaagggtgcagattgattgaagtaatttaagatctgctgtacatcatttttgaccgcttgatttaccccgtttttcgctaagtaatctggcaacagttgtaactgacggcagaaacttttgacctttccgtggcaagcataaagcatttcaatcggttcatcccaagtgacaaattcttgaggagttaaaatgtacatatagttatccttttgcgtaagtattacatcatcacatgtactggatattatatatagtaaataatcctaaattaagcctcaatcataaaaatgtgttactatctgaaaaataatgcgacctactgtggtaatgatttggctaaatcctattgagtacgtttgattccttccccctttttcccttttctgatataatcctgcctaattttcggcagattttgccgttgtcaatttaagttaatataggaacaacaatgtcagaacaaaatcaaccaaatagctatgattcttctagcattaaagtattacgtggtcttgatgctgtacgtaagcgtccaggtatgtatatcggagatactgatgacggcacaggtttacaccatatggtttttgaagttgtggacaatgcaatcgatgaggctttagctggttactgtaatgatattgtcgtgactattcattcggacaattcagtgtctgtgcaagatgatgggcgaggtattcctgtggggattcaccctgaagaaggagtgtctgcggcggaagttattatgaccgtattacacgcaggcggtaagtttgatgataattcttacaaagtgtcaggcggcttgcacggggttggggtgtcagtggtaaatgccctctcgtccaaacttcaactgactattcgtcgtgaaggtcacgttcacgaacaattttatagtttaggagatcctgatgcacctttagcagtaattggcgaaacagaaaagacaggaacaaccgtccgtttctggccgagttatgatattttcaaaaataaaacggaatttgaatatgcgattttatctaaacgcttacgtgaactttcattcttaaattcaggtgtatcgattcgcttagttgatgaacgtaatgataaggaagaacatttcaaatatgagggtggtatccgtgcttatgttgaatatttgaatgaaggtaaaaacgtaattcacccaacgccattttatctttcaacagaaaaagatggtataggcattgaaatttcaatgcaatggaatgatagttttaacgaaaatgtatattgtttcaccaataatattccacagcgtgatggcggtacgcacttagcaggtttccgtggtgcattaacccgtgccttgaaaaactatatggaaacaggggcaaaactaaaaaaagaagatgccaaaattgatgcgtcgggtgatgatgcacgtgaaggtttagtcgctgttatttcagtgaaagtaccagatccaaaattctcttctcaaacaaaagataaattagtttcttctgaagttagaaatccattggaaagctcaatgaatgaagcactacaggaatatctattagaaaatccaaatgatgctcaaaatattgtgactaaaatcattgatgcagcccgtgcccgtgaagcagcacgtaaagctcgtgaaatgactcgtcgtaaaggcgcattggatttaggggggttaccgggtaaattggcagactgccaagagaaagatcctgcattatctgaactttacttagttgagggggattctgcaggtggctccgcaaaacaagggcgtgatcgtaaaaaccaagcgattttaccgttaaaaggaaaaatcttaaacgtagaaaaggcacgttttgacaaaatgctttcttcacaagaagttgcgacgttaattactgcattaggtgcaggtattggtcgtgatgaatataacattgagaaattgcgttatcataaaattattattatgaccgatgcggacgtcgatggtgcacacatccgtaccttgcttttgacattcttctatcgtcaaatgccagaattaattgaacgtggttatgtctatattgcacagccaccactttataaagtgaaaaaaggtaagcaagagaaatatattcaagataatacggaaatggagcaatatgaattagcattagccttagatggtgcttcactttacgtaagtgataaagcaccagcattaaatggcttagcacttgagaaattaattgctgaatataatgatgttcaaaaattgtttgagcgtttaacccgtcgttatccaactgctttactgaatgaattaatttatcagccagccctcacgacagaatttgtaaaaaatgaaactgaagtgaccgcttggaataacaaaattgttgagatcttaacagctaaagaaactagtggaagtacttatgttgcagaggtattttataatgcagaacgccatatttatgaacctcaagtaattgttactacacacggaattagcacaacttactgtttggatttcaattttattacaagtaatgaatatactcgtattactaaattaggcgaacaagtaagcgatctccttgaacctacagcgtatgtacaacgtggtgaacgccagcaatcaatagaaagtgttgccgaagccattgattggttggttaaagaatctcgtaaaggtttaaccattcaacgttataaaggcttaggtgaaatgaaccctgagcagctttgggaaacaacgatggatcctgtagtacgtaagatgttacaagttactattactgatgcaattgcagcagataaactttttacaacattaatgggtgatgaagtagaaccacgtcgtgattttatcgaaaataatgccttatatgcaaatttagacatttaatccctactaaattattttgtagggcgaatatctattcgtcttattcttttctactcagactgtttatttgaggaacaaaaatgaaatacgaactaaaaaaaacaaacggcaacgctcgtcgtggtcgattaactttttctcgtccaaagggcgaatatcacgttgaaacccctgcatttatgcctgtggggacttacggcacggttaaaggaatgacccctgaagaagtggcgcaaacaggcgcgcaaattctgcttggcaacactttccatctatggttacgcccagggcaagagattatgcgtcagcacggcgatttacacgattttatgcaatggcacggtccaattcttacggactctggcggtttccaagtctttagtttaggcaaattacgcaaaatcaaagaagaaggcgtttatttccaaaacccaattagtggtgaaaaagtctttttatccccagaaaaatctatggaaattcagcacgatctcggctcggatattgtgatgattttcgatgaatgtaccccatacccagcgacctttgactatgcaaaacagtcaatggaaatgtcgctacgttgggcaaaacgcagtcgtgatcgctttgacgaattacaaaacccaaatgcgttattcggcattattcaagggggcgtttatgaagaattgcgtaaagtttccgtagaaaaactggttgaaatcggctttgatggctatgcggtgggcggtttagccgttggcgaaccgaaagaagatatgcaccgcattttagaatatgtttgcccacaaatccctgcggataaaccacgctacttaatgggcgtaggcaaacctgaagatctggtggaaggtgttcgccgtgggatcgatatgttcgactgtgtaatgccaactcgcaacgctcgcaacggacacttattcgtcaccaacggtattgtcaaaatccgcaatgcgaaatatcgcaatgacatctcaccgcttgatcctgaatgtgattgctacacctgtaaaaactacaccaaagcctacctatatcaccttgataaatgcggtgaaattttaggggcaagattaaacaccattcacaatttacgttattaccaacgtttaatggcagaaatccgccaagcgattgatgaagatcgctttgatgattttgttgtcgaattttatcaacgtatcggcaaggaagttccaccgttacaattagccaaagagggtgaaaatgcttaattaatttgacaaacacaatagtaaattgctgtttaaacttgcagagttacgttgtaaattttcttgatcaaagtaaacattgactatagattttctcaaattatcacaaggagatataaatgagaaagctcacatatctaacttcacttgctatttttacaagtgctttacttggttgcagttgtagttgtgaaaaaacgcaaaaaccacaggaagagaaaaaggatgatcaagcgttgtttgaggaaacgctaaaccctacgccccctttaccaacaagtctgttaaaactgcctggtccaccaacggtcaatttgttagcaaccagtccatcaaatactgccgaatttaacgactttatcagcattatgggacaaaatggggcggtgattacgatgtggtctgttgatcgtcgtagctggctttggatgtatccgccgcttaattctcaagattttggcaaattgcgtaattggcgaattgagcggagcttccgtcaagaacattttcgttttactaatcagcagatgggatcttgtatgcaggcttatggaaatggtgtgattcaagatagctgtgatccaaataatttagatcaagattttgagttactgccaacctcgacaggatcggtgttcattaaaagtgtttcccagcagcgttgcttaacttacaatgcggtgagtaccactggctattttacgctgactttggatcgttgtgatgataaacgtattaccccgttacacgatcaaacgttctatctcacaccaccattacttagtgctaatccattataggaggaaaaatgacgttatttaatcgagctatagcattagtatgttgtttacttcctcaaattgccttggcaaatttggaaaactatacggttgcaacgtggaacttgcaaggttcttctgcgattaatgaaagtaaatggaacatcaatgttcgtcagcttttgacggggcctcaagcggcaggtattttaatggttcaagaagctggctcattgccatctaccgccgttcatacacgccgaatggttcagcccgagggggttggctttccaattgatgaatatgtgtggaacttagggacaagaagtcgtccaaataatgtttatatctattactctcgcttagatgtcggggcaaatcgagttaatcttgcgattattgctcgtcgtatggcaagcgaagtgttcgtgattaattccagttccagtgtattaacctctcgtccagccataggcattcgtattgataatgatgctttctttagtattcacgctctatcttcaggcggtgctgattcattaagtttgattcaaaatattcatacgttctttaatactgaggaaagacgacatatcaattggatggcagtaggtgatttcaatcgttctccaggcagaatgcaagaagcattaaacacagaaccaggattaagcaatgccacattaattgttgcaccaacggaacctacccatcgttctggcaatgtattggattatgcagtgttacacaatgcgaatcaaaccacacaaaacacgacggtcagtgccagcattatgtttaatcagatgagatcgcagattacctctgatcatttcccagtcagctttgtgaaaaaacgttaagggggaactatgttaaagcgttttactttattgatgacattaggactatgccagttttcccttgcagaaacaccaccgatgccacctgcacctacgccaacaccatcaacttatcctgatgttgttgaaataaagccccctattatctctttacgcagtttaaatacgggggagccagtatctaatcggagctacgatcggaatgatccaagagaggtgcagtggagacttgtcgatgctattgttaaaaatcgtcggttcgtacaatttaaagtagttgataaagaagagcgttgcttggttggagatggtggtactttgccttgtggacaaacagacactttatttagattagtcccaacagatacaggagcatttattctgacagaacccaacacaggaaaatgtttaaccagcgagaattatggcagttatggttttcaaaactgcttgcgaacttcttcagcagaacctagcaatattccgttaaaacatctttggattattgctccgccttttggacctagtaggttattataacattacaatttttaggggctaaattgattagcccttccattccaaatgatgtaagatgttgtttatacaagatttttttaaataaaaggcatagttttcacgaaattagcaaccattttgtctactatgccaaataaaaagggttgctaatgtttaaagaaaacaaacattagcaacaaacttgtctactatgcctttgtaaaattagtccatcaacattttaaatttactgcccctattctttgatgtacaagtacattatttagatgtagataccttcactacttttatatgaaataacgaattaggtgataatttataaatataaaaattatcattatttgcatgtatctcattagctaaaataaaagtatcgctatattttgccaatatataataggttttatgatcaatatctattatatcaaaagtatttttaaaattaggacgaatataacccgttataaaagcaaacattgcaaaacagcaatatgtacagataattatatacacctgatttttatataaaaattgcatagttgctttaacagaaatacttggaatattatgatttatatagttcttaaatattaaagtaaataataatatcaataataaataacctaatccgacataagtgttacatcttcctattgaagcaatatagccaaatagaagaggacttagccctatgcaaatcaaaatatatgctcgtaaaaattgaatatacggttccggcatatatttcttagcttttattagaatatataatccaattaaataagtaagaaataaaatagccgtattccaaagcacatatcctaaacttctagcaacattactaattcccacatcaacataccaccaagggaaaccataaaagtatgactgcccccaaccataggcataagcaaccgaccacccagttacccccaaaaaagccattgaaatagaagaagaaataaatttattcgcaattttcaacataatatacctacaacttatgcggcaacttttgccaagtcacttcatttctcaaataaacaggttcaatatcaaacgccgactgtacttttccttgtacaaccttctcaattgccaaagataacatatattttgctgatggtaaggtaatctccgttactttgacagcgaggttagcctgctcaaattgtggataggctgcccagcctgttcctacaataaccgtattttgggtaggttgcatttgagcaattgctttttctggcgaacagacttgctctacaacctgagtttgccagccctgttctgttcgttcaaattgtgcaaaatagacctcattcattcgagcatctattaatgcaatcacactgttagcattcaaggtttgataagcctcttccgccattgtcagtaaattagatactggtacaacaggtaattcggcaccaagagctaacccctgagcgatcccaacgccaacacgcacacccgtaaaactcccagggcctcttccgaaagcgagaacatcaatctgttgcacagaaatccccgcttgtgtcagcaattcatctaccatcggcagaatccgttgagtatgggttcttggacttaattcatcaataaatgtggttttaccttgatgtaacaaagccactgagcaggcttcagtggcagtatctagtgctaaaatagttttgttcataatgtcatataaagaaaataatgttgaactcgcttgaaaaaagcgagacgacataataccaattatttgcctaattgacggcgttttgctaccgcatcagcaagttggaatagcactttttcactgtcctcccagccaatacagccatcggtaatactctgtccgtaaaccaattctttaccttcaactaaatcttggcgaccttcaacaaggtgactttcgatcattacccctgaaataaggtgtgagccgttcgcaatttgttgtgccacatcattgcatacatctaattgacgtttgaactgtttttggctatttgcgtggctgaaatcaatcataacgtgcggacggcgaccagatttttcgatatccacacacacttttgcaatagagtccgcatcataatttgtgccattatcaccgccacgcaaaataatgtgacaatctggattacccgctgttgaaacaatcgcggaatgcccgaacttagttacggataaaaagtggtgaggggcttctgctgcgccaatcgcatctaaggcaatcttcacgccaccatttgttccatttttaaagcctacagcacaagataagccagatgcaagttcacggtgaacttgtgattcggttgttcttgcaccaatcgctccccagctcataaagtctgcaacatattgcggggtgatcatatctaaaaattcccctgcagctggtacggttaaatcattaatatccgataacactttacgagcgatacgcaagccgtcatttaacgcaaaagtttcgtttaggtaaggatcgttaataagccctttccaacccacagtggtgcgtggtttttcaaaatagacgcgcataattacttcaagatgttgattaatatacggatttgcacgcatttcttgaatttttttcgcatatgctaatgcggctttcgggtcgtgaatagaacaaggcccgatcaccactaacaagcggtcatctgctccgtgtaaaatacgatgaactgcttcacgagcggtcgcgactgtttccgctgcaacatcacttgcgggaaaacgctctaatagtgccactggtggtaacagttcttcaatatggttaatacgaacatcatcatttttatacattgtgttgcccactttattgctcattgctataaatccttatgttatataattgttattctttctaaagtaaaagaatgccataggtttgtcaaatactccaaacacctttatctcgccagcacttctcgcttgcctcgactatctggagcagaaataatcccctgttcttctagttgatcaataattctcgctgcacggttaaagcctagtgagaagcgacgttgtacgccactaattgaggttgccccaccgtcaatcataaattgagcaatttcgtcaaacagtggatctaactcaccgcttgtgcgttctgagttttcgccattttcatcaccctctggtgttgccacaatgctttcaatatattctggtttacctctcgctcgccagttatccgccacacgctgaacatcttcatcggtcataaatgccccgtgaacacggatcatttcagggctacctgccccagaatatagcatatcccctcgccctaatagagattctgctccgcctttatctaaaatggttcgagagtcaatttggcttgccaccgtaaatgcaatacggcttgggatatttgctttgatcaccccagtaatcacatcagttgatggacgttgtgtcgctaaaattaagtgaataccgaccgctcgtgctttttgggcgatccgcataatgtgatcttccacctgtttacctgccgacatcattagatccgcaaactcatcgacaatcaacacaatgtagcttaatttttctaacggtggtggcaaactatccattgtatcgccaggtcgccacaacggatttggaataggcagatccattgctgccgcttgatcgattttcgcattaaacccctcaatgtttcggacatttaaactactcaccagtaggtaacggcgctccatctcctccaccgcccaacgcaacgcattttcggcttttttcatatccgtcaccaccggggtcagcaaatgcggaatatcgttgtaaatcgacagttcaactactttcgggtcgatcataatgaagcgaacctgctcaggcgatagcttgaacaataggcttaaaatcatcgtgtttactccgaccgattttccgccccccgtctgccctgcgaccagtaaatgcggcatttttgccatatcgaccacaatcggtttaccgctgatgtcttttcctaatgccatcggcaatgtcgctttggtatggcgaaactcattgctatccaacacatcacgcaaccaaactgtttcacgctgacggttaggggtttcaattcccatataaggtttgccggggacaacatctgtaatacgaatggcttcaaaaatcagcgaacgtgcaagatctgaagctaaattggtaatcttcgccgctttcacgcctgctgccggtttgatttcatagcgtgtcaccacagggcctaccaacacatcttccaccgttgccctcaccccaaagttcgctaattcacgctcaattcgagctgaggtatctcgaatttcttgctccgtaatttgctgttcttctgattttactgtcgtcaataaatcaatcgttggcaacggcgtggttggcttttcgacctttctcttagtttgtaacaacgggtgaataaggctatcgccataacctttcggataagttacacccttcttttcaggttgttcctctgtacttgctactgctttaggttcaacaagcggtgtattttcttgtaaaaattgcgaagctgattttgcttcttcaaaaggctctgctgtcacttccaccacagggtttaaacgcacctttggcattacaggctcagtcacatttggcactatcactgttgcttctggcaactcaacagaagttgatacagaagggacagaaacatcaaactctggaacagtaatgcttggcaatgaacttgggttctccactttgaattttgtgacatcagtcaattcaacttcagttgctacgtcttcctcttgaacggtttttaagccagtaatatgcggacgggtaaactgggaaacatctgtatattgtggtgtttcgtcactttcactctcattttcagcgactggctcctcctcatttttctctgtttgaacagcctcgccagcatttaatgtactactcggcttatcttccgtttttccatccacgatccaatgatacaagcggttaaatagttgcaacaaaatctgtcctgaacaaaaatagaagccaaccgccgttaatagcattgcaacgagcaacaataccatttgagaattgagccaagacgctaacattcccccaataaaaccacccgaaagatagtaaggggaattttcaaacaatacgctcgacaaccccgccagcccgactaaaaataagaaaaagctccctagccaaaacccaattttcgcccagtttagatcgtcagctaaccgtaaaatcaatacataaatcgacgtaaatgccagcccaaaaggaacaaataccgcaactttaccaaacatcgcaaagagcaaatcaactaaatacgcccccaatgcccctgttttatttaatgtttcgtgggtaatagaacttgccgtactccaagcattatccaacggactataactcgcccacgccgtgatcagataaatcccaaaacacgccgaaagcaacaacactaatctaatcaggttctctttcccttttaaacgatcaatcacagctaatccttatttcaaaagtagatagttagtttgcttcacttcttccatcaccacataggtacgagtgtcgttcacccccggtaaacgcaacaacgtcgttcccaataatttacgatacgccgccatatcagccacacgggttttgagcaaatagtcaaaatcccctgacactaaatgacactcttgaatttcatcaagttgctgcaccgcccgattaaattcctcaaagacatcaggtttaccacgaacaagagtaatttctacaatcacgagcaaaggggcttctaataattctggattaagtaaagcacgataccccattatgacattctgtttttctaaacgtttcacacgctccaaacaaggcgttggcgaaagcccaacacgtttagagagttcaatgtttgaaattttaccattacgttgtaattcatttaggatttttaaatcaatagcgtctaaggcttttgttagttttttattttccatttgaagacctttctagcggattgttctaaaaactccattctatcacttctttttagagggactaaggctatttgcaaaaaacaataattacagcaatcatcatctacatacattattgtctcaccattcttaaattttctggtattccttcaaaatttgagcgaaaaggattaatatctagccctccacgacgcgtataacgagcatatacagtcaacttttgaggctgagcaaattccattaaatcacaaaaaattcgttcaacacattgctcatgaaattcgttatgttctctgaacgaaactaaataacgcagcagtttctctctatctaattgcttccctacataacaaatttgaatacttccccaatctggttgagaagtaatcaaacaattagatttcaataaatgacttactaatctctcttctacaatttccccatttgcaataccttgtaaggactctcttgtaaaatcataacgattaatacagatgttttgattatctatacattctccattaaactcagaaattgatcgcatagcaaaatcagataatttataaatttgcactgtgacatctccttgggcacatttacttaaatcagactgaatacgtctttgtacatcttctcttgaaggaaaacgcatttgattaaaactattcaaataaagtttaaaactttttgactcaattatatttgaactactactatcaataataacatctgcaattgctacttggggcactccattttgattaagccatgaaagttcatagagagtccaaatatctgctcctaccgtaaaaggttgctgtttaacaatacctaaactctctctatttaaataacgaggtaccgcttgtaacaaactaggatcataagtacttttatactctgttttttttcctagttttaacatggaaagacattcattattgtaattcattttaaatccctcactcttacatcaaaaatcgttgccaacaagttgctacatactgacgttcatcaataaattcgctggcatcaacaatactctctttattcaataaatttaaacgatgaatttgatcgcgtaaaccagtataacaccctttcaatcgttcaccttcatctgcagtcaaaataccacaatccaccgctcgttcaaaaatacgaacattgtccgaccaatccgccatttgtggatattgatgggtatagtttaacacaagatactgagcaataaattcaatatccgtgatcccaccttgatcggtttttaaataaaaccgccctgcggtagttttactcagatggtggtacattttttctcgcatattgcgaatatcttctcgtaactgaccgcttgaacgctcttggcttaacgtttctcgccgaatttgctcaaatttttgtcgaagttccgcagtaccatatactgcacgagttcgcacaagggcttgactttcccacgtccacgcctcgtgtttctgatagtggttgtaagcattaaatgtactcaccaacaacccagcttctccagagggtcgcagtcgcatatccacttcataaagcacgccagcactggtattcaagttaaaaataccgttaattttttgggctaacttaagataaaactgatggcttgaaatagatttttttccgccaactgtttcgctctgttcaggggcattatgtaaaaacaccagatccaaatctgaattataaccaagctcaattccccctaacttgccataagcaatcaccacaaaatctttctcgccgttttgtaaatgttcaggctcaccaaaccgctgtgccacttgtcgccacgctaaattcaccacttccccgataatagcttctgccagataggttaggtgatcgctgattttcatcacgggcaatacccccaaaatatctgcccctgcaatacgcaataaatggctctgtttaaactggcgtaacccgtcaatcaatgcttcttcgtcgtcctctgggatacgcaacaaatactctcgcaaggcttgaggataagtctcaagcggtaagatcgtcattaaactttgctgaaaaataaactcatcaagcaacatcggataacgtgcaatttgctctgctaacattattgattgcccacacagttgcaatagttgaggcaaaatctgctctttttctaacaacaattcaaggtaagtggtacgcaaggtgattttatctacgatcttcaaaatgcgtggcaataacagtaaataatccgcctcgtgaaaaatctgatccaacactttcggcatcagcttctgtagcacctctcgccctctcactccaatcgggcgtttcacccactcttgtagagtggttataagctgttggtagatctccctatgagcttgagttgctacaggataggtcgcaagaacagtagctaaatcctcttgggtaagttgtacatttaaaatatctcgccattcggcaaattttgggttttcctcaccgctttcctcactgccgtcctcaccaatcaattcattaaaaatcgctcgaacattctgctggtgttgatgtagttgcaataaaaagctttcccaatccattgccccatttgcaaccgccaaccttgcccgatccacttcatttgtcggcaaggtttgtgtctgttgatcattaattgcctgcaacacattttctgtgtgtcgcaaaaatagatacgcctcacgcaaattatttacctgtgtttcgctcaacaaattcaactgagccaacggtggcaacactgccaacaaacttcgttgctgtaaaattttatctcgcccccctcgcatcatctgaaaggtttgcacaataaattccacctcacgaataccgccagcccccagcttaatgttatctaccagctctcgccgtaacacctcacgactaattttctgcttcatctctcgcaacgactggatcgcactaaaatccaaataacgacgatagacaaaagggcgcaacatctgcttcaaatacttatggttaatgttcgtcagatcttcacctaaaattttcgccttaatcatcgcatagcgttcccaatcacgcccctgctcttgataataatcctccatcgccgtaaaactcagcaccaaagcaccgctattcccaaaaggacgcagtcgcatatctgtccgataaacaaagccatcaagggtaatttcgtctaacgctcggatcaaccgctgtcctaaacgagtgaaaaacttactgttttccatcggcttcctaccgcctaccgtttccccaatatcaggataggtaaaaatcagatcgatatccgacgaaaaattcagctctcgcccccccagtttacccatacccaaaatcagcaattcttgcttttccccaagctcattcatcggcctgccatattcgccacacatctgctcaaacagccaatccctcgcccccaaaatcaaggcttcagctaaatccgacaaccgctcaaacacctgctgggtcgaagctcgctgattagattgaataaaactcaaagttgccatttcacgatgacgaaaacggcgtagctcacgctgtaattcttcttcatttttcaccgtagaaatcaccgcttgcaaccgctctgcataactttcaccatcctgaatttcaggcgatttttccaaccaagcggtcaataattcaggttgtttttgcaactgttgagccacgaaatccgacattgcaatagctttgataagcggtgggatttggggagaatgttgcagatgttcgggaatttgatgtaacgtcattaacgtattcaatttcgtttcagcttgagcaaaaagaaaattaaacataagaggatctcaaagttaggtggtttggggttattgtacggggaaaacaggctagtaacaaagatatcataaaagtgaaatacataaaccttatcccaaatatattaaagttaagacacacatttattcttcattattttttaattcacatgctttcattgttcaaagagctttttccaatcactctttttcgcaaacgccactctattttccgtatgtttaatgcgggtaaaaacaatttcccacacatcactgctcatcaattttgcaagctggtgctttttccaataaatttgcaatgcggtttgtttttcttgctcattttcaagacaacgagcaacggcttgaaattgaatgccttcaatttctcgaatattatcaggttgtcctgcaatggtgcctgcaatattggggttagccaacatcaatttgccgtgttcggtcgtttgctttgacagcacgatcaagcggtgagatgcttcatcaaatgcgtaaaagcaactggctgaccaaagctgatgctgatggtggcaagcaaggctcaccacgtgatttttcaagataaattgcacaatgtgtgtaggaattggattattcatctactttcctgtccagcgtggaatatcaatctcaagatcaaacatatctaacgcacgagcgacgctatgggtcacaatttcatcgaccgttttaggctgatgataaagtgctggcacgggcggaaaaataatgccccccatttcggtgactttacgcatattatccaaatgggttaagtgcaacggcgtttctctcaccattaacaccaatttacgtcgttcttttaacactacatcggcggcacgagccaataaattatcgctaaaaccgtgagcgactgacgctagggttcgcattgagcaagggacgataagcattccaatagtcttaaatgaaccgcttgaaatagaagcgcctaaattgtggatagggtgaaccacatcggcaagggatagtagctgttcttcgctgatgttcgtttcatattggcgagtgagttccgccccttttgaaatcaccaaatgggtttcgatattgtctagcggtttaagcagttcaagagctttgtagccatattgaaagccacttgcaccgctaatgccgataataatgcgtttatttaacatatttttccttgtaggttgggcatttatgcccgacgtttatgtaattggttttatgttgattttatggattgtaataattgtcgggcataaatgcccgacctacttcagaaatacttgaaaaaaatagcaaactggttactatgtgccactttattttgtttaatccgaatttgttaaattatgcaccaagacgctgttcaagacacgcaaaaagagaaaaaaattgcctataacttcaataaattgcaaaaacgcttacgccgaaatgtaggcaatgcgattgcggattttaatatgattgaagatggcgacaaagtaatggtttgtttatcgggtgggaaagatagctatactttgctggatattctgctcaatttaaggctcaacgcccctattcattttgatattgtggcggtgaatttagatcaaaaacagccaggcttcccagaacacgttttacctgagtatcttgagagtatcggcgtagagtataaaattgtcgaagaaaacacctacggcattgtgaaagagaaaattcctgaagggaaaacaacttgctcgctctgttctcgcctgcgccgtgggattttatatcgtactgccacagaactaggtgcaaccaaaatcgcgttaggacatcatcgtgatgatatgcttgaaacactttttttaaatatgttttacggtggaaagctcaaatctatgccaccaaagctaattagcgatgatggtaaacagatcgtgatccgaccgcttgcgtactgcaaagagaaagacattgaaaaatatgccgtggcaaaacagttcccgatcattccgtgtaacttatgtggttcccagcctaacttacagcgacaagtggtgaaagagatgttgcagacttgggatcgtcaatatccaggacgtattgaaacgatgtttagtgccttgcagaatgtggctccatcacatctatgcgatccaaatctctttgattttaaaggcattaaacgtggtcagctaattgacggtgttgaaggagatattgcctttgataaagcagaaattccgtctgctcctgtggttcaagataaagatgatgcagcagattatgcggaaagcggtttaattcagattaaagcggtgagttagtcgaaaaaatctgcaaaaagcgaaataaacgtttgcttttcatttttttctaggatatatttcggcacattcaattttggagctactatgaacattctctcaaacattcgtcaccgtcatcaccatttacctgaataatctttcgggcatttggcgtgttcggaagaaacttccgagcggtgcaaaatgagagtagatctaaaaaccaatttccaccccttcggaagatgatttcgaaggggttcttttttatctcgtagaattgaataataggtttatttttttattacattaagaggaaaacacaatgttattatcaaacgatgtggtcatctcgattatcgtgttactcgcattaagtttattgcgaattaacgttgtaattgcgttgattattgccgccttaacttgcggtattttaggtaattctggcaacggaatggcattaggtgaggctttaacgacaaccgtaaaaagtttcactggtggtttaggcggtggtgctgaaactgcaatgaactatgcagtattaggtgcttttgccgtcgctttatcaaaatcaggtgttaccgatttactggcatataaaatcattaaagcctttggcaaacgcccatctggtcgttcactgttttggtttaaatatgcgatactctttacgttagttgccttcgcaatggcatcacaaaacgttattccagttcacattgcgtttatcccaatcgttgttccaccattacttagcgtaatgaaccaacttaaaattgaccgtcgtgcagtcgcttgtgcattaacctttggtttaacggcaacttatatgttaattccagcaggtttcggtcaaatctttatcgaaaatatcttggtaaaaaatatcaaccaagcagggcaaccatttaacctagtgaccaacactgcagaagttactcaagcaatggcaattcctgtggcgggtatgatcgtgggtttattattagcgttctttgtaacctaccgcaaaccacgtgtttatgtggaagatcgcccagaaccaaccgctgatgatattgaagctcgtgtagcaaatgtgaaatcattccacatcggcgtgagtatcgcagcaattgttgctacctgttttgttcagttatcaacaaactcaacggtattaggtggcttagtcggtttgattatctttgccgttggcggtgtgttcaaacttaaacaaagcaacgatattttccaagatggcttacgtttaatggcgatgatcggctttgtaatgattgctgcttcaggttatgcaagcgttgtaaactcaacaggcggtgttcctgaattagtagaaggcttaaaaggaagcattgatagcaaaggaatggcagcgttcttaatgttgttagtaggtttacttatcactatggggatcggctcttcattctcaacagtgccaattattacatcaatctatgtgccattgtgtctttcattcggtttctcaccgcttgcaacagtatcaatcgtaggtgttgcagcagcattaggtgatgcaggttcaccagcgtctgactcaaccttaggaccaacatcaggcttgaatgctgatggcaaacacgaccacatttgggattccgttgttccaacctttatccactacaatatcccgttattagtgtttggttggattgcagcaatgattttataggaaattcccccccctttttttcaaagggggggaaattttgttttaatttggatcattttctctcattaaatcccctttgaaaaagaggcatttagagagatttaaaggacaatatgaaattcatctcttttaatatcaatggcttgcgagcaagaccccaccaactcgaagcgcttattgaaaaacatcagcccgatgtgatcggcttacaagaaatcaaagtggcagatgaagatttcccttacgatttagtcaatcaccttggctatcacgtttttcatcacggacaaaaagggcattatggcgttgcacttttaaccaaaaaccaaccgcttgcagtgcgtaaaggtttcccaacggacaactcagatgcacaaaagcgtatgattatggctgatcttgaaacgccattcggaacgcttaccgtcttaaacggctatttcccacaaggcgaaaaccgtagccacgaaaccaaattccctgctaaagaaaaattttatgcggatttacaacgttatttagaaacagaactcaagcctgaaaacccgattatcattatgggcgatatgaacatcagcccaacagatttagacatcgggattggcgaagtgaaccgcaaacgctggttgcgtgatggcaaatgttcatttctacctgaagaaagagaatggctaggacgtttacatggatacggtttagtcgatactttccgagcaatgaacccaacggcagaaggcaaattctcgtggtttgactatcgctctaaaggttttgatgataaccgtggtttacgcattgacttagtacttgcttcaaactctttggctgaacgctgtgtcgaaacaggcattgacttagaaattcgagcaatggacaaaccttctgaccacgcacctgtgtgggcagtatttaagtagttgctcaataagttgcttgccttctttagattattgacaatgtagcttgtagataccctgtcaataatctaaaaccacttttaatggtgttttttaacgtagttatgattgtgttagaacgtaaaaaataatattagagtatcctccactcgatcatataaaaatcacttaatccattgatttaaatgagattttttcacaaaacatttaatttaccgacattttaccgtcaataaaacaatctacatcaaattaatacatttaataatatcattgcaaaaatgtgacctacctcacaaaataaggcacagccccaaaactggacgttttgaaacaaacattcatgcgaaaaaatggcgattaacctgtgaagatcatcaagacgattctttaacatcctatccaccgtccgttgcatttgggattagacgacaatgttaagtaggctatgtgataatgattaaatagcagcctgttcaagagacgatgcggtgtaaaatatcccatctaaatcaccgctttcatcagatttcccgcctattatttctaacttttttaataattgacaataaaagttgaaaaatgcttgttattttattctttattttatgtaaatgttgtttttttttttttttttttacaatggagtggggacatctgtacaccctgaaaatgtaaataaaagtttatgatgctttattagaaaaagcgttagagaagaagattattattatgaataaaatatttagagttatttggagtcatgctcaacaggcttgggttgttgtatctgaattagtaaagtctcataccaaaacatccacttacacggataaaagagctcaactatgcacctcacattattttttagataaacagcaagataaatttaaattaagtcttttaagtctagtattactaggtatattttttagtccagtaggttcagcagcatggcttcaaaatgattctagtcaagggtatctaggaagtgacggtggttctattggtattggtgaaggtagtaaggttgggcctggttctattgtcatcggtcagtacgcaaaagctgaaggtaggactgctattgcgataggttatatggcacatgcaggagatgtactgtatggtattgcgatagggtctaatagtaggtctagtggttattctattactcttggtagtaacacgaaagctgctgggccagattccgttgcgataggtaattctgcgcaaatagaagggatagactctgttgttattggtgcccatatcaatgtgacaggtgagaaattagtggcaattggacgcgaagcaagtgctggaaattattctactgccttcggttataaagcctctgccaatggtataggctctgttgctgtgggtgaacaggcaaataccaaccaagcaaggagagcaaccgcacttggtaacaattcaattgttcttgttggtggtggcgtggcgttaggttatggttcgagagcagaaacgtttgggggtatagatggagcgagacaaacccattctgtaataacagatgcaagtactgttaacaatggttttaaatcaacagaacgtgttggtgacagtcctgagggtcatcctaaaggttctaatgactttcttatcggtgcagtttctgtgggtaataataaaatcaaacgccaaatcgtcaacgttgcggcaggtaaagaattaactgatgcagtaaacgtggcgcagcttcaatcgctcacaatgaaaattggtggagattccaacgctgaagaacaaccaaaagttggcttgtgggaaggtacgctcaacgtaaaaggcgaaaatggtcttacttccgaggcgagcggcgatacgattacggttaaattaaccgaggaaactaaacaacaaattgataatgccactaaatcaggtacgtttcactttaacactgatggcaaattgtcaatagggacgccaggacttgcaactgttgatggtgtagtcggtgctgtaaataatgcaggctggaaactgcagaccgttcagggaaacggtggtcaagctagttctattcattttgatccatatcttatcaaaatgggtgcgactgtaacctttaccgccggaaataatattaaattagaacaaaggaacgaaaatattacgatttctacgcttggtaagttaattaaagaaacgcaaaccttagcgggtggcggtttgaaaattacttatactgataattcaaccgatactattagcggtggtgcaccaggtcctgcgggcccaatgggtccaaggggtgaacgaggagaacgaggaccacaaggtgatccaggtccaatgggtccacaaggtgctaagggtgatccaggtcctgcgggtgcaacaggtccgatgggtccaacaggtccaaggggagagcggggtgaaccaggtccgacaggtcctgcgggtccaacaggtcctgcgggtgcaacaggtccgatgggtccagcaggtcctcggggtcctgcaggtgagcaaggtccagcaggccctagaggtgaaaatggtcttaaaggtgacaaaggtgaacagggtgatcagggactaaaaggtgaaactggtccagcaggtcctgcgggtccagttggtcctcggggccctgctggtgcaccaggtccaatgggtccacaaggaccgcaagggaaagagggtccagttggtcctgcgggtgcaacaggacaaataggtccagaaggacctaagggtccgaaaggggatgctggtccagttggtcctgcgggtccagcaggtgctaagggtgatcaaggtccagcaggtgcaatgggtccaacaggtcctgcgggcccagtgggtccagttggtcctcggggccctgctggtgaaacaggtcctagaggtgaacgaggagaaccaggactagcgggtccaacaggaccacaaggtgtaccaggtccagcaggtccagcaggtcctgcgggagagcgaggtgagcgcggttctgagggtccacaaggtcctagaggtgaaaagggtgaaccaggtcctgcaggtgagcaaggtccagcaggccctagaggtgaaaagggtcttaaaggtgacaaaggtgaacagggtgatcgaggaccaacaggtgaagctggtccgaaaggtgaagcaggtccagcaggtgctaagggtgatcaaggtccaccgggagagcgaggtcctgcgggtgcaacaggtcctgcgggagagcgaggcgagcgcggtcctgcgggtccagttggtccagttggtcctcgggggcctgctggtgaaccaggtcctagaggtgaacgaggagaacaaggactacaaggtgcaacaggtccagcaggtcctgcgggtccagcaggggctccaggagtagctggtcctaagggcgatagaggtgaagctggtccgaaaggtgaagcaggtccagcaggtcctcggggtgagcgaggagaaacaggagcaccaggtccaatgggtccacaaggaccggaagggaaagcgggtccagagggtccaagaggaccacaaggtgaaataggacaaacaggtccagaaggacctaagggtcctaaaggtgatccaggtcagaaaggggatgctggtcctagaggtgaaactggtccagcaggtcctagaggtgacaaaggtgaacagggtgatcgaggagaaacaggaccacaaggtgcaccaggtccaatgggtccacaaggaccgcaagggacagcgggtctaacaggacctaagggtgataaaggtgatccgggaccaaaaggtgaaactggtccgaaaggtgaagcaggtccagcaggtcctgcgggagagcgaggcgagcgcggtcctgcgggtccaagaggagagacaggtcctgcgggtccagcaggtgataaaggtgatacgggtccagcaggtcctgcgggtccagttggtcctcggggtgagcgaggagaaataggaccacaaggtgcaccaggtccaatgggtccacaaggaccgcaagggaaagagggtccagttggtcctgcgggtgcaacaggacaaacaggtccagcaggacctaggggtcctaaaggtgatccaggtcagaaaggggatgctggtcctgcgggtccagcaggtcctgcgggtgcaacaggtccgatgggtcctccgggtccagcaggtgctaagggtgatcaaggtccaccgggagatcgaggcgagcaaggtctgaaaggggatactggtcctagaggtgaaactggtccgaaaggtgaagcaggtccagcaggtcctgcgggagagcgaggcgagcgcggtcctgcgggtccaagaggagagacaggtcctgcgggtccagcaggtgataaaggtgatacgggtccagcaggtcctgcgggtccagttggtcctcggggtgagcgaggagaaataggaccacaaggtgcaccaggtccaatgggtccacaaggaccgcaagggaaagagggtccagttggtcctgcgggtgcaacaggacaaacaggtccagcaggacctaggggtcctaaaggtgatccaggtcagaaaggggatgctggtcctgcgggtccagcaggtcctgcgggtgcaacaggtccgatgggtcctccgggtccagcaggtgctaagggtgatcaaggtccaccgggagatcgaggcgagcaaggtctgaaaggggatactggtcctagaggtgaaactggtccgaaaggtgaagcaggtcctagaggtgaaaagggtcctaaaggtgacaaaggtgaacagggtgagcgaggagaaacaggaccacaaggtgcaccaggtccagttggtccgcaaggtcctacaggtgctaagggtgagcaaggtcctagaggtgaacaagggactccaggagtagctggtcctaagggcgatagaggtgaaactggtcctgcaggtcctaaaggagagcaaggtttaacgggtcagactggtccagtgggtccacaaggagcgcaaggggttgaagcgggtaaaaatgtgaaagtgacttcacaaacgggtgcaaatgatcagaatatttacaaggtgagcgtgtctggagatttaagcgatattacttcaattagtaatggcgatacgaaagtatctttaggtaaagatgagcaaggaaatccagttgtaaatatgaatggtgccagaattaccaacattggagatggtagtgctgagggcgatgttgtgaatgtgcgtcaactaaacaaagtggtttcttctgtgaatacaggatttaatcaattgtcgaaagatattggtcgtgttgatgttaatgcaagagcgggtattgcttctgctgtggcgatggctaatttgcctcaagtaaatttaccaggtaaaagtgcgatttccgtttctagtgcacaatatcgtggacaagcagcttatgcaattggctactcaagagtttctgataatggcaaatggcttattcgagcgtctgttagcagtaatactcagcgggatactacgattggaggaggggtaggttttgtgtggtaatctagcacctataaattagaatttcatgctcaatgccattgttattttaacaatggcattgttttctatagtgggtttagtggtaggtttgaataaatttttgataggcattcaaaaacgtttcaaaatcttctaatccgcaaaaagcgatactttcttcatcatagaaactaaagccgttttcaacatcttcgatttcttcaaatgtcatatccagattatttgctttcaccatcacttcttcaatgttgatataaaggctatattctttaccttcaaaaatccattcgtagttttgatctttggtttggcgacaatgctcaatttcagcaaaaatagcggttaactcttttggatttggcacaatctcggtatttaaccaacgagcaaatgcctcgtgatccattgaacatttggcaataacgccgtgcatggtatgtgtaaattggtattccatcattttctcctttcaaacaagcggtcggattcgtttggttttttgcaaaatattataacgaagtggccgcttgcaactacaacttaacctttcttcaaaatctcttttaaaaatcttgccgtatgagatttcttatcttttgccacctcttcaggcgtaccttcggcgataatctgtccgccaccgctaccgccttcaggacctagatcgacaatccagtctgccgttttgatcacatctaagttatgctcgatcaccacaatggtatttccttgatcacgcaagcggtgcaatacggtcaataattgtttaatgtcggcgaagtgtaatcctgtcgttggctcatcaagaatatagagggttttgcccgtacttgtaacccttcacgccctacactaaagctgatcgtacattgctctaagcgagacgtttcaagatcgttttgactaaacaacgcattcacgcctaaagtaattcgcaaaagatcaatatcagggtcaatcaccgtgcgagaaatagggtgttctaatttcacttctgcacccacagaaacttctcgctctgacgcatcaaaatcttcaaggggttgctggtcttgatagcctaaacggtaacgaattaacgtgttttgataattccattcccctttcgagtttttgatcggcgtgtaatcaaagaaggcactctgatactgatctgctgtcaccgcaccacgaataggaccgagtgaaattaagccaatcgcacttaatcgctgtgctgattttaggttatcgggtgcttcgtaaggtgtatggccaccaccgcctgaacttccgcccataatgtttctccaataaaaaagccgttacagtttcctgtgcgactgtaatttgtttacgttgtcacatcatcaaaggtatcaataccctgcgaaatcaagataagacttgtcatcatttttccgtaaagcaacggaatcggtctgccttgaggggtaagattgcgaatgtttgagaatgatgtactttgctgtttttcgctatcacttaatttcgtgttcatatctggtggacgagcaagcagttgcattactccgcccattgccattgatgcccccattgctccaaccatcattgctgtacctgccgtccaacctaaaggattccaccaagctactgcaataagggcaacaccgacgatcgcttgtacaaatcctacgcttttccctgcccccaccaccacaggcgtaaaatgtacagtgcaatcatctgcaagtgtcattgtaggattggtttttatctgctcttcgcttaaatagcgctttccgattcggactttgtaatagccttttcgcaaatgttggctcaagccttgaatctgactgagtagtccgctcatcagctctttaaaggaactgacttcaagcactatcggttcgttaggctcaaatcgtttaagattgccgtaaaatttaactctgaccatttcgggtatctccaaatactgtgcgtttgttgtagccaagcgccgtcataaggcacacgagcagataatcgcccttcgctgtggtgtaacatcatttgattaccaaggtaaatgcctgcgtgattagccacatcactaccaatttgcagtaacacaatatcgccaagctggggctgttcttcaaaatctaaccgctcaaagccaaagcggagcaagttttcttcatacaagttgcctgatttaaaccattcaaactcgtactccacatcgtcaggcaaatccaatcccgacaacatataagcatcaagtaagatgttgcgacaatcctgcttgttattctcaaactgacgaccaacaagcggtgcgatggggcggaatttttgcaaattgccatcgcaaaccaaccaaaacggcagatttaaccgcacttgacattctctatctgcggttgatagataaggcaaacccttctcggtgtctgaatcagggtgagaatgaacaaccgccacaatctcacctacgctttccgcccgaatccaatcatcaggtgaaatttcaaaatgattaatcagatcgacagccacattttcacaaggaaaataacgtaactcaccgcccttagaaacgacaaaaccgcaactttcgtgcggttctgagcgtttggcgtgagttaagatttctttacttaaagtatcattcaccataaaaataaacatttttgttaatttcatattgacttaataaacatttttgtttattattaccacatcttaaaaacacggaggattaatgaaacaaagtgaatttttaagatggctaattgctcaaggggtagtaaaggaagaaggctcaaagcacatcaaactttattacaacggtaatcaatcaacaatgccaagacaacctagcaaggaaatcaaaaacggcacaatgagagcgattaaaaagcaattaggtttaaactaatcaaagcccctgtaacagggggcttttttagcaaggagtaatatttatgctgtatccagcacgattcgaatttgaagatggtagttataatgtttcattccgtgatattcctgaagcgttgacttgcggtgataactacgaagacgctttagagatggcaaaagatgcattgcttaccagtatggatttttatttcgaagatcatcgcaaagtaccgttaccaagcccaccacaagaaggcgaagtgctgatcgaattaccgacaagtattttcgccaaagtgctattgctaaatgagatggtcgatcagaatatctccaatgtggaattagcaaaacgaattgccgtaaaaccgcaagaagtacagcgtattactaatcttgggcatagtacaaaaatcgatactattgcaagagcgattaatgcactcgacaaacagtttgaattacgtgttgtctaattaccatactgcgtcgtacttggaaagcccccaaacggtaaaatggcgttagccccgaatctcagcttgcaaccacgcaaacagtgggaacaagcgtcttttttcggatcggttgtcgggttatctttttcatcggcaacaggtccgcctgtgtagccacactccgcagagcgatattgccaaatacaggtgtctgatgtaatcatcaacaacggtatgcgagcattatctgtttctgcgggtaaagccagctcaaaggtcgccacttcatcatttaggctttttaactgctcaatgatgaataaactcacactttcctgtgtcggatcggcttgtggatttcgtccatttggaaaattacgagcatcaaggaattgtgcatagactaaacgacgtgtcacctttgccccaattccttgtccgaaatctgcggctaaagcggtgacaatgccgtacaggtttgagattgtcaaagtcggtcggttactcggcccttgaccgctaatttcaaaaccgtccgcattaattggataggcttggtattcgttaccttgccaccaaacattctgctgaccttgatttaagccattgtgaaagcgtaataactcccctttttgtgtttggtcgctattactgctgatatgccttaaatcaatttcccacagttcaatcaaggcattttgttccagttttggcagttcgtttgccattttttggggtagggcttttggcattacatactcctatcgtctaaattgaccacccgcacgagcgaaattattggtgatcgcattctgactttcttctcttgcgattcctctcattgtttttaacaattccactgtgatgtgagttccatctggcgtttcttcttgagaaactttggcatctactgcattaccattgttgatgatttgaacatttacagatgatttacccgatgcttgatttcggtttccttgatttgctaaaaaggcttttaaatcttggttagtacggctatctacaactcgctcgccacgatctagcaaccaagttccttcctttggtatgctatcaatacctgagtgagccataccgctcaaacttatacttgtcagttgagaaataacactcatcccagccgaagccaccgcagccatatttgcgaatttctgagctggtgtcatcgctgttccatcgcccattgcctgcacaatcgcttgttgaagtctaaccattgaatctgcaactgcaaaagcttttgacatcgcaaacattgttttataaacaccagattgcttgcccattgattgtgcagctaaatcagccatttgaccaaatgcaccgcctaaattttgcaacccagcagagtaatttgataaatcctcaagaatcgttttactacgatattgttcttcaagttgattttttcttttcaaaaaatcttcgtgactaattagcatttgatcataccttgactgattttctgctagtttcgtagcttgctcattcttcattgcttgcatagggtcgaactctgctttccattggtcatagccgttcaccgcattttgcccagctaattgtgcctgtttatttccagcctcccaagtggcgttttctgtggcttttttcgcttggtcatgagttaaaagccctgctgcattgagttgttgaatatcttgtaaatgctcttttagctcgcgtgcatattgcaactcaggggcgaactgttctgctaattttgcacgttcattggcaaaacgttgtgaaatcgccaattttgctgactcatattcttcgtgtgaaactaccccttttttattatgctcttccaaacgttggaacattcgctgttgctcggcgtcaatttcttcaagggtggaacggctgtgtttgcgaacttcatcataaaattgaagccaactatcgcgcgcttttttaccaccgccgctattactcaaactttggttaataccctctgtttgcgtctgatctttgaacatcccttgtaatactttccggccctcaatcagtttatttaaggtttcgatagataaatcaatgcctttatccgctgcattcgctgcagtaatcgtacctttggcaatatcaattagcacttgattatattcagcgcctttatcgccaagcaattcatataagccggctaaaacaaaggcggactctgcctgtccttgctgttttaattttgccacttcaagattttgcgctaccgttaaagcgcgttcttttaattttttaaacgcctcatctagatctagattgttctttactccaccttgcgccgcctctttctgttgttttatcgtattgcttaaatcggcaatgacgctatctgccgtattggcatcaacacctaagtttttcattttggtacgaaaatcatcaatgcttttgccatttgacaagaacacctcaccaagtgcggttaattggttggttaaaactgaaagatcgatatttttattttctcgaatcttttctaattccgcgtttaacttttcaagatcttgcttggaactttcagacagctccaaaccaaattgccaagcacttgtttgaatttgggaaatttccgcctgcactttggaaatttgctcaccataattttccattgcttgaatttgctcaaaaattttcaaggttaacgcgctttcacttaagccgtcataactttcttttaaacggttattcgcactctcggtatctaacgccgcctcttttgcctcttgtgccttttggctgaaataaaataatgcacctgccgcaattgttgccgctcccatagggccaccaataagacctaatgcgccacttaataaatttttggctcctgcggctgcactgcttgcaattgatgcgcgttgagaggctgcagcaagattattcatagcagccgcctccgcattaataagccccgtaataacttgcgcttgttgagccattttagcctcaatcgctgctctagctttcttggttcgtactaattgcatttctgaattcaacaaattcattttggcttgtgcagccgctaattctgccgctgcttgggtttgtgtggctttcgcagcgattaaactcgcttgcgcttgtctgtgtgtttccactcgagcaagaaccaacgttgaaataaacttagcaccattgccagctgcaattgccaaaagtacaccagctaaatattcaaaattctgcgcaagaaaagaaatacctgtcgctaaattttctgtaatacctaaagtgcggttttgttcgtctacaaatttcataaatgcgttttccatttgttgcattgcaccaccaaatgaaatcggcatttgttcaaatttttggttaattttttctgtttagccattaaaggcgtcaaaaatcaatttagatgttaattgtccttcgcttgccagttttttcacttctgcacggcttttacccatatattccgctaatacatcaagaataatcggggcggattccgcaatggttttaaattcatcaccttgtaattgccctgaacccaaagcttgcgacaactgaaataatgcacttgcttgagcctcagcactcacaccaccgacagccattgctttattcattgtttcagtaaattgcagaatgtctttttgtgcatatccataatcttttaaggcacgagctgaacgcgtgtataatgaagttgttgcctctacatctgttttacattcactcagtgatttaggttttgttgcagatgaaccacctgcaccaccgccaccaccgcttgagccagagccttttagaatagaatttttgttagggtaagcatccactaaagcctctaacgcctcttcaaaatccgcacgttgccccggttttactcgactgaaaatttcattgccaaacgcatcttttgccaaaattgcaccgttttcatcaatgctaaaatgcttaccaaagaacgcttgagccacatcaacaggcattgccagtttctccgtgacaaacttagagcgagcaaacgaaccgccgatcaactcagtatgcaattgaccttgcactttctctgctaacgctttggcatctgccagtttttgctcatagcccttaatcacttcttgtttaaccttttccgcttcacctgcatcaatcagttttttagcatcaaggttttccaccgtttttaaggcttcttttgcttttgccacatcatcaattccgtcaaactttttgagttctgcttccgctttttctttagcctcacggtgttgcttgttttcagcattgagcgaagaaattttttgcattgcttgcggtgcatcaaaagggatttccttcccgtcatcgtggatatacacaggtttgccatctacaaccacaacattgccgttttcatcgagttttaatttcatttggatttccttcctaagtgagtttgtgtttcttccgaaacgtggataataaaaaaccgcttatacattgctgtataagcagtttggttgaaatttaggtataaaaaaacctagcatttaggctaggttaataattgtagctccacaaaatgagaaagggagctacaacggaaatagctctgcttaatttaatttcatcattctttcataggcttcacgcttgctttctcgcaatgattgtatttctgacttcgtcagctgtcttacgtgaattgaggataaatctcgcttcccattctgtgagttttgagaaatcatagccaaattcttctgtccaccagtgttcaatactgccatatttttccctcaattgattcagtgtttctttagataatcgtaattgtacagaatattgttttcctgtcaaagcataagcaccaacaactttgccattttgttgctcaatataccctttaaggctggctaatgtaccaccttgcgtttgagtatcatcgagaataatagccagttgacctttaggatattctccatcaaatgcaggggaataaatcaatctatgccaaccatcacctgctgttctagaaaccttagttgcttgaacaatggaaagatcgacttttacattcaatttcttcgctagcactgtagcagttgctacaggaatcatatttctaccaacagcttcttcagcgtgaactggaacaataataacattccgaccagcgatgattttacgcaatttatcaattgcttcatctgaaacaagatcttttgccaaatggtaagctgcatcaataccccctcttttggctaattcataaagagggtgagatgttgcctcacctaattttctatctataactgtatcgggaaaatcgtctgaccaatttgaacgcatttgttttattactccatcttgagtattaaattttgcatttaaatttgccaaagtcaacggtctcccactctgatctaacatatccgcaaaagtaattacacctctacgccataaatccgccttgcctttacctaatacttggtcttgttgctctggcgatttgcttttcaaccaattttcgtagttaatctgctctgatacaggaccatcttgacttgctcttgtgcttgacggcatttcttccgcatcaatcccaagctctttccagctcttggttacaagctgtaaaatactgcgacaacgtgggtgtaaaggcggtcgttgataaggtacatcgtggtctatcggctttttatctaaatcccacattaacccatctcttaattgacatactgttgatgttcgtgtgtctagtgtagaaaggtgtttttctcctgccaaaatatcaaggttttcatctcttaaggcttgatgagctttatctgccactttagctactgcagtaatgactaaggtttcagcgtgtctgcgagacgtattcatcaaatgcttaacatcggtaatcatttgacttgtttgctgaccatctagcaacccttggcgaataattccttcaaacttaaaggcaaaatcatttccttgctttgcccaccaatcttctaaaggcgaacctgcaataatcgttgcggttttattcgcttttcgcttatattcaggcacttgattaaaaaaatcaaagccgacttcatcattgtaaagctgatgaatatgttgggtttccgccgtgaaaaaaccgcttaactcgtcttgcgtgtaagcggtcatttcttgatagacttttgccacttcttgcttaagctccttaagcagtgtgtctaattgttttttaggtaaagcatccacacctgcggccgctaaacgattgagcaactcacgttgtgttttactcagctgtttcattacctgctgtctaagatgtgcatcataacgaaaatgcagaattttgcgatcagtcaaggcgtatgcaatacgactattcaggctttgtttcggcttgtcctgcgaactcaaggtcatattctaccccctcttcatttaagcgagcttgttcatcttcccattccacattatcgctaatcaaaccacgacgttttgcttcattaaagacggtttgttttgaaagtgtgcctgcttgttgcattttaatgaccatatccattgaggcatttggatcgagatcgtcatcaatattaccgctaatttccaccttaccgacatcatcaatacccaaccacaacccaacgtattccaaagctaaatctaacgcatcttcaaatttattcgcatacagtcgcaataaactgatttctttgccctgctcttctttggcttgactgtctgtcattgctaacacggttttatctaagagtttcgccccggcaacacgcatttggctttccagctctttcaaactgtcttgccctgcgttaatcgcattgcctgaatgttcgatataagcaatttgagaaccggctggtaaatgcaacgcactaccaccaacttgtagcttattgacttcagtatcggagaaaatccctaataacggcacacgagcggtatttaaaatgttgtcctgatcggattgtgattgccaatgcttaacattcaaataggccaattcaagcaacggcggctcacctaatgcaaacacattgctttctttcgtaataaacggcacaacaggcaccacttcaagcggtcgattttgagcaaggagttgcacatcatcaatcagcgtccattgcccctctgttgctttatacttacgcatacggccgatttcgtacacataaattattttttcaatcttcgaaccaaactcgccatcatctaccgacacttcttccatatagcggaactgcgtgatttgtcgtttccctttgattttatccgttttaaatcccaaaacatttttaggcttaatcaaaataaaataagggcgagcattagccgctttctcatcggcaatggtacgaatattctcagtacgggtgtaatccactaagcaccacgccacgccgtaagttaaacctgcattaaaccaacgagaagaaaatacatcgacattattcccctctaaatccacatcaggcaaaatatcttgctttaatttatcgtgaacgtcatttgtcgtaatcggctcaaaaaaaactctacctgtcatttggtagagcgtttccgataaagcaggataaagcgttgagcggttaagtctgtttttataagcctcttcttcctcaagactgaattgataaaggtatttcttccctgcttgtcgcattgtttttgttccgccaagcaaatcatcaatcatcacacctttttcattcaacgccctaatttctggcatcacaatagcaacatcagacataaattatccttagtaaagtttaagtggattttggctaaaatcccctttccgctgaatacgaggattaagcgcataccgcaacgcatcaatatagtggttatgggcatcaactaatgttggcaacacatcgccagacaagcggtcggttttgtagctatacaagcgaaattcattcaatgtttgctgacaacgtgggtgaatgtagattttcttataggatttaatatgcgcaatcccatcttcaacgctacctttccattttggcacgccatcaatacgaggcaagccgtgtcgctttaaatagctaatagactcaggtcttgctgaatccgcgcgtattacatactgctcaatgccagcaatacctttctgcaaaaatgtagctgtatcatcaagctctaacccgattttgccggcctcatattcaatatacaattcatcatcaaacacccagcatttaatcgctgcggttgggtcgtgagcaaaaccgaaatccaacccgtgataaggcccctcaaaatcaggtaaaggcttaaactcaagttcctgatattttcctctaaagacttgagcctcactttcttcaagataatccccctcccaaatccaacgataagtcgcatcatctaaacgggctttatcccttaagcgttcttgctctaatacatcaggaaaccacggattatcgctataattcatttcaacaatcgccatactttcgtcttgatgttgtctaaagcgtaaatccgttgccgaacctttcttttcagggttccacgttaaccaaatttccgaaccgctttcacgcaccgtaggcagaagtttccgccacgccatttcgctcacgctttcagcttcgtcaatccacgcaagtaaaatccgtgcttttgatttaatgctgtcaagattgtgtcgtaaacctgtaaaaatataggaaattcgaccgcactttgtgcgtacatatttctcgccaacctcaaagaaatctgccagccacgccgcgctttgaatggcttgcttgatttcctctagtgatgagtcttccaacgagttcataaactcatgaccacacaaaatcacaccgctttcgccttgcattgcccgttgatacgcaacaacagcggtcatcttggcaaaagtgcgtgttttagccgaaccacgcccaccataagcaccacgatgacgcgcatcctgacgagtaaacacaggaataagtttaggggggagattaagttgtactttcatctggagcgaccaactcaataatagtaggacgaagtgagccgtcagagtttgttacatcgactttatccttaaacataccaagatgtttacctaatagctcaagtgctttatttgctgcgtgaggctcaaaacaaactttctctacatccataggaacaatagaaccatcaaccttgcttagttctgtttctgtggagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacctaacggttacacatctaagaccgtcatttgtgatgaaggtgagatagaaattaagacgcctcgtgaccgtgatggcacctttgaaccgcaacttatcaagaaaaaccaaacccgcatcacaggaatggatgagcagattattgccttatatgccaaagggttaagtaatcaggaaatcgttgaaatgttcaaagaactctatgatgcggatgtatcaaccagcctgatttctcgcgttaccgacgcggtgaaagagcgcgtaatggcatggcaaaatcgcccacttgatgcggtttatccaattgtttacctagattgtatcgtagtttcagctttgtattgtgcatttagtgcgtaacagcttgaaattcgtttcgtggaaagattacaaagccgtcactgcagatttaaagcaggtttatcaggcccctacggaagcacaggctcgcgaaaatctgaccgcactttcgcaaaaatggcaggcaaaatacccgcttgtagcgaaaggctgggaagataactgggcaaatattgccacattttttgattatccggctgatattcgtaaagcgatttataccacgaatgctgtggaatcgcttaatagcgtgattcgtcgcgtgattaaaaaacgaaatgtattcccgacggatgattcagttttcaaagtgatttggcttgcgattaaagatgcatcaaaaaaaatggacaatgccgattcagaactggaaactggcgatgaatcgatttatgattgattttggtgatcgcctagacgatcaccgttaagttgaaatgggtgtttacacagaatttgggatagggtcgttataagttatccccaataatttgacaatgccctctaatttcctctgtggaaatttcagtcattaatttatgtccaaaatacttcttaatttccctttcgtaagtcgcaagtcttaatgctcttgtactttccgcaaaatcagtttcggcaatatatttaagtgcaaacgcttcaaaattattcgcactttttatttgatttttcttcttccgtttttctgtggctggagaaatcccatcactcaccattttacgagccatcattagcttttctcttgcttcaacaaaagatatgccgtcctttccatattttcctattgttaatgtttctcttcgtccgttaatacgataatcatacctaaacgtaaccgtgccggcaggagatacaacaacgtacaatccatcacgatctgctactttataagccttatcctttgcttttaaagatttaattttactatctgtcagcattctcccccctattttaaaataccgtcaaattaatgacggtattttgatattaagggataaacaggtcaatccttaccgacaatttttacgcaaaaaattgaaatactatgaaaagctgtgaataagtgggatattattcccactctatcgtagctgggggttttccgctaacatcatacaccactcgagagatcccgttcacttcgttgataatacgatttgagattttgcctaatagatcataaggtaaatgcgcccaatgtgcggtcataaagtcgatagtttccactgcacgtaatgaaacaacccaatcatatttacgtccatcgcccattacgcccactgatttgactggtaggaacacagtaaaggcttggctgactttgtagtaccagcctgaagcgtgtagttcttccataaagatcgcatcggcacggcggactaaatcgcagtattcttttttgatttcacctaacacacgcacgcctaagcctgggcctgggaatgggtggcggttgagcatttcagctggtaagcctagtgccaagccgattttacgcacttcgtctttgaataattcacgcaatggctcaactaagcctaatttcatataatccggcaagccacctacgttgtggtgcgatttgatcacgtgtgctttgcctgttttgctggcagcggattcgatcacatctgggtaaatcgtgccttgcgctagccatttcactgaagtcaattttttcgactcatcatcaaacacatcaacgaagactttaccgatggttttgcgtttcgcttcaggttcatcaatgcctttaagagcatctaagaaacgatcttcagcgtttacacggacaatgtttaaaccaaatttatcgccgaacatttccatcacttgatcgccttcgtttaagcgtaataagccgttatccacgaatacgcagtgcaagtttttgccgatcgcacggtgtaaaagtagagcggtcacagacgagtccacgccgccggataagcctaaaatcacttcatcatcgccaacttgcgctttaatgcgagccacggcatcttcaatgatattttccgctgtccatttggtttcgcagccacaaatgccgaccacgaaatttttcagtagttctaaaccgctttttgtatgggtcacttctgggtggaactgcacaccatagaaacggcgactttcgtccgacattgctgcaattgggcaagttggggtgacgcctgtaacttggaagtttgacggtaaacgggtaactttatcgccgtggctcatccaaacgtctaattttggttgagaagcggtcaaatcatcgtttaattttgcaaataagctgtcggttgtttttaactcaacagaggcatagccaaattcacgatgatctgaagtttcagtcaaaccgcctaactgcatcgccatagtttgcataccgtagcaaatgccaagcaccggcacgccggcgttaaacacatattcaggcgcacgtgggctgttttcttcggtggtactttcaggaccgccagaaagaataatacccgttgggttaaattcacggatctgttcttccgtcacgtcccaagcccaaagttcacagtaaaccccgatttcacgcacacggcgtgcgatcagttgggtatattgtgaaccaaagtccaaaattaaaattttatggttgtggatgtttgtcattttgtttctcttgatatttgatggttaaattttctcctgctacaagttttagtaatgtgtagctttcaggtagtatggcattaacttcagtatttagcttgcttgctttattagcaacaataagattgccatgtcgattagattttaaattgcccccaaacttattaattaattcaataattttacaatattgagcatctatatttgctttatcttttttgtcaaattgataaaaatacataattgatttttcaacattccaaaatttatttaataattgattatggtaatttaaaaaactttcaggagttgaagtaaaatcttctgagctgaattgatagatataattatcaaaatctacgatagcatttataaaatcttttcttgcttcagggatacgctgagctcgccacgacaaggccgtataaagtgcgacaataaataataaaactgtgccgaatgcaattatccaatttgtaacactgccagtatcaattctactccagtcagaaaaacctaaaccaaatagtattccaattattataccaatagatattaaaagaatttgttctgttatatttttcattttttgtcaaccaagcggtcaaatttccacaaatttttgcaaaaactaaccgtaattttgcccctacacacggaaaaactcacatgattacgaggctctaaggacctatgagttactatgcaactctttgttcatttgtaactcccagctccggaggagctgaactatgcgtaaccccgtacggcttgccgtgcggggaaaatatcgttatttcaacttctttttactttcctcaatcattttcttcgccgataaatcactcacgacttttttacctgttttgctctctaactcttgtaaagccactttagcaacattgccaccttgttcggcgactttttgattttcttcaaaggtttcaggatttactgcttgcgaaatatctttggttgaggcttctgcaagcatatttaaaatcaactcggtgttcgtcatattatcgcgtaagttttctttttttaatcctttgaattgcttatattctttggtagtttttccgctccacgctttagtgataatatcggttaaaacggcaaattgttgcccttctttcacaccgacccgtttccattcgtccgtcaattctttgcggatttcaatgctttttaaacgttggttaatccaattttccgaatagcctaatcgcaagtaatcctgcattgctcgattgatagtaagttctggatcttgcaattcatctaaacgttcacttcccacttgtgctaaccaaagtttaaatggctcagctttcggggacggaatggattgaattaagcgcagtagttgcggtacatcggctacgtcagttagtcgtaacttgccatcttccgctctcattttcaactggttacaatttgtaaccgtttcatttccttcttttaataaacggctttttagaactttccaatagttccttgcaccttgataattgggttgttccgtcaaaatttcgattacatcaataatcgaaaaataccatttttcttgttcttcgtcccaaacggaacgcacttctttgtgtccaaaaagtttgatgtccatattttcaaccattattaaattgctaacttagttttgcttatgctgattaaaccacccaacataatcaaactgatcgtaaaaacgtttcccattcaaaccgcaatactcaaacagatcgcctattttttgctgttgttcaaagccttgaatataaactgcggaggttagttctggatatggtttatgggtaaagacaactttattcttaaacggtagttgttcaaattcaagcagatcttcatagcgacagccatctcgctctgccatcataatgaaaagattattgagatccattcgagcggtgcgttcttgccatttttttacagcttcttgctctgaatgatagtacataaaataaatgtgaatatcgcctagtagcccaacggggtattttctttgaatttctttggggaaagtgatttcttgggtttggtagtgggcaatattttttacatatttaataaaatcagtgggggttaaaaataaatttacaaaaggggaattaaagcgtaaacctaaatcgtgcaacataaaagcccctgtgcagttactagcaattacagtcagggtgttagtgtttaatcgttggcgatttttggcgttgtgttttttgcgaaaaaaatcgttgattttatttgttatttttctgattaaaggcatttatattccttgttagcggtaagattttcccattattttaccgcttgttttcagtattatgtatcaaagaaagaaacaaggggcatcacgcttggtgtccatcgaataaagcaggacaccaagcgtagcaaaaaattaactcattcgatagttcggcgcttctttcgtaatggttacatcgtgaacatggctctctttgatacctgcaccactaatgcggacaaattgtgctttggtgcgaagttcatcaatggttgcacagccagttaagcccatacaagagcgtaaaccacccatttgttgatggataatttctttgagtaagcctttgtaaggaatgcgaccttcgataccctcaggaactaatttatctgcggcattatcggattggaaatagcggtcagatgaaccttttgacattgcccctaatgatcccattccacgataggctttgaatgctcgcccttggtaaagctcgatttcacctggagcttcttctgtgcctgcaaacattgaacccaccattacacaagatgcacctgcagcaattgccttagcaatatcgcctgaatagcggataccaccatctgcgatgacaggaatgccacgatcttttaaggcttccgccgcatcagcaattgctgtgatttgtggcacacctacgcctgtaacaatacgagttgtacaaattgaacctggaccgataccaattttaactgcgcttgctcccgcatcagcaagggcaatcgcaccttcagcagttgccacgttgcctgcgacaataggtaagttcgggtatttcgcacgggtttcacgcacacgttgtaacacaccctcagagtgaccgtgggaagagtcgataagcaagacatcaacaccagcctgaacaagagcatcaatacgttcttcattacctggaccagcaccgactgccgcaccgacacgcagacgacctaactcatctttacaggcgttcggtttttgttcagctttttgataatctttaacggtaatcatcccttttagtttgaagttatcatccaccattaacactttttcaactcggtgatcgtgcataagttctaaaatttcttcacgattagccccttctttgatcgtcactaaacgctctttaggtgtcatcactttagaaacgggcttatttaaatcacgcacaaaacgggtatcacgagcggtgataatacctacaaggttatcttctgcatctacgacaggatagcctgcaaaaccatttttcttcactaattcagctaactcgcctaatgttaaatcaggggaaacggtcactggttcagaaacgataccgctttcaaactttttcactttacgcacacgatctgcttggcgttcaattgacatatttttatggataaagccaattcctccctcttgagcaagggaaatcgctaacttagcttctgtcacggtatccattgctgcagaaagcattgggatatttaagcgaatgtctttggtaagttgagtagaaaggtttgcggtatttggaagcacggtagagtgtgctgggacaagaagaacatcatcaaaagtcagtgcttctttaattactcgtagcattgcaatagttccttaatttgaaagttaaaaaataaaactggaaaaattgcgagcggattatacagagatttagttgagttgtaaatttacaagtggttagatttgttaaattttttgccaaaaagatgggctattagcccatctatctttgttagacaatctcgtaatacaactcttgatactgctgtgccacttttgcccaaccgaaatcttgagcaagggcattttggcgtacgctcgaccacaatttatttttaccccataaattgatcgcacgcagtacggcatcgtagaaattatctgcgtcaggatagttaaacacaaatcctgttgctgtgcggttttcaatgctttctttgtgtgcgtcattgacagtatcggctaaaccacctgttcggcgaactaatggtagcgtaccgtattgtaagccgtaaagttgggttaaaccacaaggttcaaagcgacttgggactaagataacatcaccacctgcgataatttggtgtgaaagagcttcatcataaccaatttttaatccgattttatgtgggtaacgagattgtgcatcacgcaatgcccattctaagtcaggcgatccactaccaagcactacaagttgaacgttgtgttgcatcatttggtcaatgcgtgcaagtaagaaatctgcccctttttgttcggttaagcgagtaaccatcacaaataagagtgcatctttatcttctggcaagccaaagtaacgttgtagttccgatttgtttttacctttaccttgcatatagttcgggcggtaatttgccacgatgtttgtgtcggtttcagggttccaaacagcatcatctacgccatttaaaatgccacgcaatgccccttctgcaaggcgttgttgcagtaagccgtgcattcctgcccctgcaatttgctcagtaatttcacgagcataggttgggcttacggttgttacacgatctgcgtagaataaacctgctttcagataagagatttcgccgtaaaattctaaaccgtgaacattataaaattcccaaggcaaggctaattctgctaagtggtaggcttggaaacgtccagggtaggcgatattgtgaatggtgaagacacttttcacagggctgttccagcttttgagataagcacaagctaaacctgcttgccagtcgtgagcgtgtaacacatcacttctgccccaccaatgatctaaacctgaagcaagttgtgctccgagataacctaatagtgcaaaacgtttgtagttatcggtgtaatcttggtagttgtcgtcgtagtaaggtaaacgacgatcaaagagatgtggggcatcaatcacatatacgcctaagccattcaaataagcaaaacgaacagtgacaacacctgcaaaggtaccgacggtcgcaacttcaacggtttcgcctaacttggaagccacttgtggataataaggaattaatactcgaacatcatttccagctgattgttgtgcatagggtaacgctcccattacatcagcaagtccgcctgttttgataagcgggtacatttctgaacaaatatgtaaaattttcattaactatttaccaatttaaataaattcttcccccacttgtgggggaagtggttgagtgaaacgaaaccgatgggggcaaataatcccccatccccacctttggtgggacttcccccgtaaacgggggaagaattataaattaagcagccgctttatcttttgccaatttatctaacattttttggcaaactaagacgataccacctttactgatacggaaatatttcgcatcttcttctggatttacaccgatttgtaagccatctggaatatcacagtgacggtcgattactgcacgtttaattacacagtttttaccaatgttcacttgtggaaggatcacagattgttcaataatggaatcttcatggacatgaacacggctaaaaagtactgaattactgatctctgcatcggtaatcacacagccccctgcaatcaatgagttatcaagggtatgcgcacgcgcttttttatagaagaaacgagctggtgcagtttgttgtggacgaccgtggatcggccaagattcgtcatataaatctaattgaggtttttcgctgactaagtccatatgtgcagcccaatagctgtcgattgttcccacatcacgccagtagatcgaacccgttgtgttacgaccttcgcaagaacgctcaaatgggtgagcataaatcacaccttgttcaacggcttttggaataatgtctttaccaaagtcgtgtgaagtatctgggttgctgacttctttttctaacatttcatagagataatctgcgtcaaacacatagatccccatagacgcaagagatgagtctggtttgtctggcattgctggtggatctgacggtttttccacgaaggctttaacttttaatttttcattaactgccatcacaccaaattccgttgcttgttcacgtggcacttcgatacaacctacggtacattttgcccctgaatcaacgtgatcttcaagcatacggttgtagttcattttatagatatggtcacccgcaagaataatcacatattttggacgatagtgcgatttcatcatttccatattttgataaaccgcatcagctgtaccacgataccaagtgttctcatcaatttgttgacgagctggaagcatatcaatgtattgattacgctcataaggtaagaatgaccaaccacgttgtaagtggcggagtagtgaatgcgccgcatactgtgtaatcaccccaactttcaataagttagagttaatacagttggaaagggcgaagtcaataatacgacggctaccaccaaaataaaccgcaggttttgcacgtttgtcggttaattcataaaggcgtgaaccacgaccgcctgctaagataagaactaaagtttgtgcagtaagattacgtctgtcagttgatgcttcctgttttagcatattgttatctccaaattgggatggtgaatattaattcctttgaagtacacatacctcaatgtgattgagagtaaccgcaagcgtatcggtcattagagtggtttctttttcacctaaaagtatttgccaatcacccttaggtaataaaaattgttgcattgcttgtttggcattgaccaaaataagccatttatcttctaatagtatttgtaaggctttggttgaatagtcttgccaatctttaaattgaataacattcgcatcagggcgtagccactgaactttttcaccagaccaccattgattatcacgagataacaaagggatctgcttacgaatagcaatcagctttgacgtataatcaatcaatgcttcgtcagcggtttgccagtcaatccagctaatctcgttatcttggcaatagctgttattgttaccttgttggctatgccctaattcatcaccagccaacaacatcggtgttccgctcgagagcaacatcgtcgccagcagagcttttttcgctaactgccgttgctcaataatcgttttatcgttggtatcgccttctaccccgaaattatggctgatattatttccgtgtccatctcgattttgttcaccatttgcccaattatgttttttgttatagctgactaaatcgtgcaaagtaaaaccatcgtgagcggtaataaaattgacactgtttgaaggtaaacgatggcgagcaaaaatatcatcactgcctgcaaatcggcgaacaaacagccctaaatcaccgcttgtttgcaaaaagaaacgacgcatatcatcacggaaacggtcgttccactcggcgaatggtttagggaatgcccctaattgataaccactccagccaatatcccacggctctgcaatcaacttaacgtgagataattttgaattactatatatcgctgtaaaaaaggcggatttttccgaaaacgtcggagaacgtcctaagacagcccctaaatcaaaacggaaaccatcaacgtgacactctttaacccaatagcagaggcaatcaatcacccaacgcaacaccgccacatcagacgacacattgagcgtattgccacagccagtccagtttagatagtcactattatcagtaagccaataatatgcttcattatcaatgccacgctgagatagcgttggaccatctttaccagcttccgccgtatgattaaagaccacgtccataatcacttcgatccctgctttatgaagcgttttgaccaactgcttaaattccgttagcggatcggctttgttataagctaatttaggatcaaccgcaaaatgccctaaaacgttataaccccaatagttgcataacccgattttttgcaaatgcggttcatcaatatgataggtaatcggcaacaattccactgccgttacccctaaacgtttcaaatgagcaattgacgtttcgtgggctaaccctgcaaaagtgcctgcaatttcgcttggcactttaggattaagtttactaaaccctttaacgtgcgtttcataaataatcgtttcagcccaagaggtaaaaggtttatagtcaccttcccaatcaaaagtatctcgtgcaaccacgacagattttggggctaggtgagcattatctctcggatcattccactgaaaccatttcaccgcttcatcactggataaatcaggttgtcctacaatgccatttgcataaggatctaccagtaatttattggggttaaacaggtcgcctttttcttcatttacacaccctgttacccgatagccatattgcgtccctgcttttagaccgaccacaaacaaatgccaaatttcatcggttttgatcatcggtaaacgaatttctttaccgtcgcaaaaaattgctaattccacaccgcttgcacggcgagaaaacaatgcaaaatttacgcctttttctccatttatttcagttaatcggctacctaatggaaatggtctgcctgcaaggtacttcatatacagccttagtacttattgtagggacacactgcgtgtgtccgacatcttaaacaattatattatttgaaatcttcgctccccctgtttacggggggagctgggcgaagccctgaggggagaacaataatatccccccttccgccttcggcaccttcccccgtaaacgggggaagggaatttaatcaactttttgtaactactacataatgtagaacatttgaattattagatttgtaattaatggacacacgcagtgtgtccctacattattttgcttttgttgctttcgttttaacagctttaccttccgtcttcgcttttactgctttgactttttccactttcggctcttccgctttttttaccacttttgtagattttttcgcttttttcaccgcttgtggtttggcttctttgacgataaaaatcgtcgcaagcggtgggatagtgagcgaaatggaataaggtttaccgtgcgactcaatctcttcacattgaatagtaccgaaattccctaagttactgcccatatagtaagctgagtcagagttgagaatttctttatattccgcatcttcgtgaacgccaaaacggtaattatcacgagggatcggggtaaagttactgaccacaataatgcttgctccctcttttgctttacgttcaaaggcaaacacagactgctctgcatcatcaacaaccaaccactcaaagccagcaggatcgtaatccaactgatacagtgctggatattgacgataaatacggttcaaatcacgcacccagttcaacatacctttatgccaaccgccgtgttcatcgttaagcaagaaccaatccaaactctcttgataattccactcacgcccttgagcaaactcattgcccataaagagcagttttttacctggataaccccacatataaccgtaatatgctcttaggtttgcaaactgttgccagcaatccccaggcattttaccgagtaacgaatatttaccgtgaacgacttcatcgtgggaaagcggtaacataaatttttcgctatactgataaatcataccgaatgtcatcaaatcgtgatgatatttacgataaatcggctcggtcttcatatagcgtaatgtatcgttcatccaccccatattccatttataatcaaagcctaagccgtgatgttccgttgggtgagtaataccagcaaaagaagtggactcttccgcaatagtcacaccgcctttgccttctttcgctaacatatcattcgttgaacgtaagaaatctaacgcttccaaattctcacgaccgccatagcgatttgggatccactcgccatctttgcgagagtaatcacgataaatcattgaggcaaccgcatcgacacgcaatgcatcaataccgaaacgctcaatccaataaagcgcattacccgtcaaatagttacgcacttcgtgacgaccataattgaaaatcaaggtattccaatcttggtgataaccttcttttggatcggaatgttcatagagatgagtaccatcaaaatacgccagactatgttcatcggttgggaaatgtcctaccacccagtctaaaatcacattaatccctgcttcgtgagccttactgattaaggtgcgtaaaccttcaggtgaaccaaaacgactggttggggcataaattcctgttggttgataaccccaggagccatcaaatggaaactctgtgactggcaataactcaatatgggtaaagcccatttccttcacataaggaattagctcattcgcaatctcttcataatttagccaatagttattttctaaattacgtcgccaagagcctaaatgcacttcatagacagaaatcggctgatcaggatcgttcgcacgacgacgtttctcgtcactctcaacaatcgcaggtaaaccagaagcaacagaagccgtatcaggacggaattgagctgagaacgcataagggtctgatttcaaacggatttgtccatttctatctaaaatttcaaatttatagagcgttccttttggcaagtttggcacaaaaatatcccaaataccgctgtttggatgaaaacgcattgaatggcgacgaccgtcccaatagttaaaatcacccaccacagatacacggcgagcattcggcgcccaaaggctaaagtgaataccgccaacttcattttgggtaacaagatgagcacctaatttttcataagggcgaacgtgggttccttcagaaagcaaccaattatctaaatcggaaaaatgggactggaaacggtaaggatcttcaatatcaatttcagtgtgggcataacgcactaacaagcggtaggaaaggtcagttttttcaccaaccaaatccgcagcaaagaagccacgatcatcaatttgctccatctgcacaatcggctcactgttatcattaataactgttacctgttctgcttcaggtagataagcccgaacaatcacgccatcatcaacttgatgaacccctaaataagcaaaaggatcttggcaacacccgttcgcaagctgttctatgaattgattatcttgcttgagtgaggtggtatttttaactttttctttcatttgctctccttggctgatttatatacgctgggaatgatgaaataaacgtttgcgtagcattctattaaaaatagctttacaaaacaatcacaatttttgatatagatcataatctcatagagaaaagctccaatagttaaaaatcaataagttaaataaaaaatgatagatataaaaaatttttcaaatgtataaaaaattttcatttgaaatatggaacttaactttgtaaataaaagtaaataaagatgaattactttatactaactcagcagtgcggcactgcctaaaagatagggaacaacttccatcgcatcagataaatgcacaaataagtggctggtttccacctttgcataagcacaaacgcccagcgttaaattgagcgtaaatacaacaaaaaagcggttaaagttgttcaaacaatgatttacccaagtaatcattttcatctttaactcctgcaaagcacgcaaataatccgctaccgatatgggtaatgtattcgttcatcttgtcgatattgccaaggctgttttgaatggtaataaattgttgcggatctttttggaacgagataaacaacaagcctgcatcaaactgccctgttttcggatcaacaccgctggcataagagaaggaacgtcttaacatctgtaaccctgtctttttcgccaaatgcaaatgggaaatttcaggaattactggatcgcctttttcatctttctgctcaagattaaccgtatcaaactcctgttttttaccaatcggtgcaccgctatcccgatggcggccaaaggtttcttcctgcccgttaagatttgtgcgatcccaagtttccaaatgcatttgaatacggcgagcgactaaaaatgtaccgtttttcaaccagttatcgccctgataccagacagtttcatcaagagctttgccttgcggattacccgtaccgtctttaaaaccaaacagattgcgtggcgtgtcgcctccttcaaaggaattaaaaccggcttggctccaacgcatcgtaatgttcgcacgagcagctcgcaccaagttacgcacggcgtggaatgctacttgcggatcattggcacaggcttgaatacagatgtcgcctcccgtgtaatgctctttgagctgatcacgcggaaagtgcggtagatctttaagctgttttggcttgaattgtgcgatacccagtttatcaaagaaagatgccgtgacaccaaaggtcagcctgagattatacggatttaagctgtccgcttcgcccgtatcggttggcggaatgtaggcattgtcaggatagctttttacattcagcccctgcgttaatttggcactataatctgtccacattttaaacatctctttgattttattgagatcggtggaatgtagatctaacaccataaaatagatgtttttttgggcaggtatggcaatgccctgttgatgtgttccgtaaaaggaatagatatttttaattttaggcgttgctctcggctccaaggcaaaagcggtgccagccatcacgccagcacccaataccgcagcttgtttaaggaagtcacgacgagcagtagaatttgttccgctcataacttatccctatttaccaagaagaatacccatttgagctaaaggctcgcccagtttgttcactgcttctgccagtgctttaatctctttatccgtcaaagtgttgtaaggcacgtaatcatagccgtcttttgacttattatgtttcgccaataacacattcacatcttggaagcgatcagcaatctcttttgccaatttcgcatcttttttctctaattttgccttaaagatctcataaattttttccgccccttcaatgttggctttgaaatcgtaaaggtcagtttttgagaaaatctcttcttcgcccattacttttgtggtggatacttcatttaacaaatccaccgcaccggtaatcattaaatcaggggttacttccgccgttggaattttcgcacgcaattctttcacatctttgatcaactgatcagcggtcgcttctgtgccttttgtggtattttgctcccaaagtactttttcaattttatggaaaccagaccaatctttctcggtttttccttcttcgcttaaatccgcaagacgagtatcaatacgagggtctaaatcgccaaaactctctgcaatcggctctgaacgctcaaagtacatacgtgcaagcggatagatttgcttcgctttttgcacatcaccagctttcaaataccccacaaatttctcggtatctgtcactaattgatcgatttgcccaacgacaaattccttataagtttgggtttctttcgataaatccgttgcaaagactgaactggcaacaaataaacttaaaatcgcaagggtgagagattttaaacgcatagaaagctcctttggtttgtctcattaagagaaataaataaaacttattatcaataagaataaaactttcatttacgttttacaattgaatttactacaaaattaataaaattttaatttagcttaatttttaagctacaaaacagtcaaaataaaaacagattctttaaaaagaaaaaagccgatcaactatttagatgatcggcatacaataattacatttaatttgacgttaccgtttcttcgcaaactctttttcaagttcaggtaacacttcttcacgataccaacgagggtggtgtttcttcgcccagcggactgtaacccaaccttcaaccattcctcgaattgaacctttcacccagaatgccatatacatatgcaccatgatgccagtgaacaacataaaggcacaagctgagtggaataagatcgcaatacgaattactggaattgagaaattatgtgcgaaatattgacgccacataataattcctgtaatcagcaaggtgaacattgcaaggatcaaagtccagaacaacattttttgacctaggttatatttgccgttgtcggaaactgcgtgttcgttaccttttaatacttccacaatgttaactaaccatacccagtcatttttctctggaatattatgatgccagtaaatacgaaccatatttacgaaagcaaggaacataataatccctgtgaatgggtggatcattcgggctaattgcggtgtacctaaaatatccactaaccacgcaaaatcagggaagaaaaatgctaaccctgataagcctgtggtgaagaagcagatcaccagtaaccagtggctccaacgagcaggcaatttatggcgaacgattcggtaatcgttagggatttgaatcttactcatctttgcctcctttatgttcttcaccctgttcaccgtggtgttcttcgtgttcgtcaagatcctctgtatttggaccgattgcgatatagtgtgcaatttcagaaagaaccaagccgcccattgccactgcagcaactggtttgagtacgtctttccaaagggtgacacttaaatcaatctgcggatctttcggtaaacctgagtatagctctggcttgtctgcgtgatgtaacacatacataacgtgtgtgccgcctacgccttctgggtcgtataagcctgcattttcgtagccacgagatttgagatcggcaatgcgtttagacgcatattctttcatctcttctttgctaccaaagcggattgcacccgtagggcaggttttcacacaagcaggctcttgtcccacagtgacacgatccacacagagtgtacatttgtacacacggtgatcttcagggttcattcgtggaatattaaacggacagcctgcgatacagtaaccacagccgatacatttgtctgattggaaatctacaataccgtttgcgtattgaatgattgcacctggtgatgggcaagccttcaaacagcctggctcagaacagtgcatacagccatctttacggatcagccattccaaacggtcgttttcttccacttcgttaaatcgcattaccgtccacgctttcggattgagatccgcagggttgtcatagaccccagtacaagctgcatctggggttgaacgaatgtcgttccactctgaacagcccacttgacaggctttacagccgatacaagtggtgacatcaatcaatttcgctacttccacttgatgactacgagcctgtggcggtggagttaagaatgaaattgcagaggatttaataatatcttgagattgaactgtactcatattatgcccccacaatcttctcaatattgactaacatacatttcgattcaggcgtttgtgtatttgcatcacctgcacgaaccgttaagttattggcaaagaaaccttttttcgctccagtggttgccgcaaagccccagtggattggcacaccgatagtgtgaattggttttccatctgacactaatgcacggatacgttttgtcaccactgcgaccgctttaatatagccacgtttagagctgactttcaccatatcaccgttattaatgcctttttctttcgcgagtgcctcgccgatttccacgaattgctccggttgagcaatcacgtttaagagagcatttttcgtccagtagtggaaatgttccgttaagcgatatgttgtcgcaacataagggaactcagcagaagtaccaagctgttctttatccgttggtaaaatacgagcaactgggcttgaaaccacattcgggtgtaatgggtttgtaccgattggcgtttccattggctcatagtgttctgggaacggaccatcaaccatacgctcacgcacgaataagcaacttaccccttcaggttgcataatgtatggcaatgtcgggctatctggcggtgcagcaccaaagtcggcaacgtccacatagttccagtttttaccattccatttaacaagctgacgtttcgggttccacggtttgcctgataaatccgcagaggcacggttataaatgatacggcggttcattggccacgcaaagccccaacctaaggtattacctaagttagatgggtctgagttatcgcggtttgccatttggttgcctttttctgtccattgacccgtgtagatccagcacgcacctgaagtcgtaccgtcatcacgcatttgtgcaaagcttgaaagtagctgaccttttttcaaaataacattgccatttgcatctaaaagatcttctaaggcatagccgttattctcttttgccacttcttctgcttttggttcaagtggatttgcatagttccagctcattgcctccaacggttcaagcggtgcttttccgccttctttatgataaaggtgaattaattccgcacgcaattcagagaggatttcgccgtctgttttcgcctcacctggtggttctgcccctttccagtgccattgtaaccaacgtccagagttagcaattgagccatcttcttcaacgaaacaagtggttggcaagcggaatacttctgtttgaatttcttcggttttcacgtcgttaaattcgccgtaatttttccagaattcagaagtatcggtaataagcgggtcgaaaataactaaatatttcaaattgcttaatgctttaacaattttttgagaatttggataagaagcaattgggttcattccttgacagaagaaacctgttaccttgccttgatacatttcttcaatgtaacgaagctgatccataccaccttttggtagtttcggtaagtagtgcaaaccaaaatcattgtctttggttgctttgtcgccatagaacgacttcaacatactcaccataaatttaggtgtgttaccgccgtagttcacttgatctttcatcatctgtttaggcgtaatacgttctaggaatttttctaaagaagtatccgcttccgttggtaatggaagataagctggtaaacgatttgggaataaacctaagtcggtgataccttgtacgtttgagtgtccacgcaatgcgttcacaccgccacctgcaaccccaatgttacctaataacaactggataattgccattgtacggatattttgtgaacccacagtatgctgtgtccaacctaacgcataaaggaacgttgccgctttttctggtgcagcagttttcgcaatttcttcacagaaaatgtggaaatctttttgtggtgtacccgtaatacgttcaaccatttcaggcgtataacgtgaaacgtgtccttttagcatattgatcacacaacgtggatcttgcattgtcatatcacgttttggttgcccttcttcatcaaattgataaccccaagttgaacggtcgtatttacgcgtttcagggtcataacctgagaataaaccgtcttcaaacttaaagttttcattcactaagaatgtcgcattggtatagtgtttaacgtattcgtgttggatcttatcgttttctaagagataacgaataacacccgataagaatgcaatgtcagtacctggacgaagtgacatataaatgtcagccacagcagcagtacggttaaagcgtggatcaaccaccattaacttcgcaccgttctgttttttcgcctcaatcgcccaacggaagccaacagggtgggcttctgcggcgttaccgcccattacaataacgagatcagcgtttttaatgtcaacccagtggttagtcatcgcaccgcgaccaaatgatggagcaagacttgctaccgttggtccgtgtcagatactcgcttggttgtcagtaaaaacgataccgagagaacgtacaaatttttgagtaagaatacccgtttcattactacacgcagagcctgctaagaaacctgctgtcatccaacggtttaccgtttcacccgcttcatttttctcaataaagttagcatcacggtcatctttcatatggcgagcaatacgctcaattgcttcgtgccaagaaatacgtttccactcttttgagcctgcttcacgcacttctggataacgtacacggcgatcactatttacataatctaacgcaccagcacctttcggacataacgccccacggctcactgggtggtctgggtccccttcaatatgaataagtttcccacgactattcattgctccatcgccaagactgtatagcaacataccacagcctacagcacaataagtacaggtgttacgagtttcttttgctcgtaatagtttgtattcacgaggtgcggctaatgctgttgctggggcaaatcccaacatagcagcagacgtacctgccataccacctgcacagatcttgaagaattttcttctactgacctgcataaatcactccaaaccgcatttgcggtgtttattaataaataataaaattttgtctattaactaggattaaatactaaatgaattttagaaggcgatgagcaaataaaaaatcttcataatgccttattttgcaattattaaatattagatatttgcccgtcaaataagcccctttataatagtaaacatcatcggaaatttttactatagaatagttagtttttattttctgaaaaaataattcttgctttttcttttgttcttgcctttgcattttagcctgaaaaaatgcccaaataaaagatgccacagctgttaggcaaaaaacaaagactaaaaatttaataaataacataatttaacgccttataaaatagttttaacaacctaacaaaataattaatgatattatcctactaaaccaacttaaaaagcagcactattacggattaattaccatctatttgatataagctaaaattctgtaaatgatacaattttttaacaaaataaactacttaataaacaaattttttcgaggaataatgtgaagaagatcactaaatttgatgtagatcgactttttgttgagaatggttctctacaacagcaatttcaacaagataatatcatcagagaagtgcctgtggctctcgtttataatggaatttcacatacagttatgatgtgtacccccgacaatttagccgattttgccttaggtttttcccttgccgaagggattttaaaacagaaaagcgacctctacggcttagacattgttgaaagttgtaacggcatcgaaatccaaatggaaatttccactcgtcaattcactcaattgaaagagaaacgtcgttcaatggcaggcagaacaggctgtggcatctgtggggttgaacaacttgaacaagtcaaacagagttaccaaacttttccacaatcgcaccgcttgtcaaatatatcccctttaatcttagatgattgtttagctcaattagaacaggctcaaactctagctaaagaaactggggcaagccacgcagccactttttttagccctgacggcacactcttagctatcagagaagatgttgggcgacacgttgccttagataaactgttaggctggtatgcaaaagaaaatgccccacttggctttgtgtttgtcacaagccgagccagttttgaaatggtacaaaaatgtttagcttgtggtattgaaatgctttgtgcgatttcggctaccactgaaatggcagtcaatatcgcaagggaaaacgactttacactactcgcttttacccgaaaaggaaaggcaacagtctattcggggggtaatcgtttgtattttattaaataacccataataacatccgcatacaaaacatgcggatgttattttatctcaaagagaaattaagcattaccgccagtgattttcgctacttctgctgcgaaatcttcttcaactttctcaataccttcacctacttctaaacgaacgaagttagctacagaggtattaactgattttaagtaagcacctacagtttgtgatggatccataacgaatggctgaccagttaatgaaacttcgccagtgaatttcgccatacgaccttcaaccattttctctgcgatttcttttggtttaccagagttcattgcgatttcgatttggatttcacgctctttagcaaccacttcagcagaaacatcttctgggtttacgaaatctggtttagatgcagcaacgtgcattgcaactttcttaagttcttcttcagcaccttgaccagcaactaatacaccgattttcgcaccgtgtaagtattgtgcaatcacttgaccttctaagtattgaacacgacggatgttcatgttctcaccaattttagccactaatgcagcacgtttttcttcgaattgtgcttgtaatgcttcgattgatgtacctttgtttgcaagtgcataatctgccacttcgtttgctaaaccaacgaaacctgcatcttttgctacgaagtcagtttcgcagttcatttcaactaacacaccgaaacctgcaccgatacgagcaaggataacaccttcagctgctacacgacctgcttttttcgctgctttcgcttgacctgatttacgcatattgtcgatagctaattcgatatcaccgtttgcttctactaacgcttttttacattccatcataccagcgccagtacgctcacgaagttcttttactaatgctgctgtaatttcagccattttttattcctctcttaatagataaaaaagcaggggtataattgcccctgcttcacaatgttgaatgtgttttaagggcttgccttaaagacgattactcagccgcttcttctgcaacaaattcagcagcaacggtttcttgaccacgaccttctttgattgctgctactgctgcatctaagtaaagttggatcgcacgcgctgcgtcatcgttacctgggataacgtggtttacgccagctgggcttgcgttagtatcaacgatagcaaatacaggaatacctaagttatttgcttctttgattgcgatatgctcgtagtctgcaccgataacgaaaattgcatcaggaagaccagccatatctttgataccgcctaagcttaattcaagtttagccatatcacgagtacggtctaatgcttctttcttcgttaatttgtcgaaagtaccgtcttgtgattgcgcttctaaatcttttaagcgtttgattgattgacgaacagttttccagttagtcaacataccacctaaccaacggtggttgacatagaattgttggctttctactgctgctgcttttactgcgtcagacgccgcacgtttggtaccaacgaaaagaattttaccgttgttgcttgcaatgcgggttaactctgctaatgcatcgttgaataatggtaatgttttctctaagttgatgatatgaacaccgttacgagcaccgaaaatgtaaggtttcatttgtgggttccagtaacgagtttggtgaccgaagtgaacgcctgcgttaagcatatcgcgcatagatacttgtgccataagaattgtttccttgttgttgtttctgctactgcagaagggttttgcctccacatatcctaagtcatcgaccgtttctcttaatagaaaaacagcaccccgatgtttagtttgtgatatgtgtgtgatttagtgaataaaaaataaaatgtttttgcctacattaatctgtaaggacaaaaaactggcggattttacttgaatctgaagcaaaaaaccagcacttttcaataaaacatgtacaagattttgaaaatttatatattaagaaattattccaatagaataacaactagtttcgtaacatcacgctattgttcctcgcgtttaaacaccaattctgtgtctgttgaagccgtttcatcaaaccaataaccgccgtaattaaagtctttaagctgttcaatgctggttggctgggtttgcaacataaaccgcaccatcattccacgagcttttttcgcataaaagctaatcactttgtatttgccattcttttcgtctaagaaaacgggtttgacaatttttgcggttaatctctccgcttgcaccgccccgaagtattcatcggacgcaagattgactaagatgttatcttcttgtgcatcaatagcttgctggagatgttgagtaatgatgttatcccaaaagtgatataaatctttgccttttgggttagccaatttcgttcccatttctaaacggtacggctgcattaaatctaaaggttttaataagccatatagccccgataacatacgcaaatggcgttgagcatagtcgatttcagcattggttagtgtttctgcttctaagcccgtataaacatcacctttaaaagcaaataatgccgctttggcgttttgctcattgtgttccattgtccattcggcaaagcgagcaacatttaggcttgccagtttgtcgctaattgacatcaatgatgccacttccgcaggggaaaattgtttgcaaatatcaattaattgctggctgtaagcggttagttcaggctgagaaaatacaaatccgtcaattttagtttcaaaatcaagggttttagctggggaaataatggcaagcattttgacctcaaatatgtggcaggtaacacagttgggacacactgcgtgtgtcccaacggattattataaaagtagggacgccacgcttggcgtctatttatataagtcacacttcgtctttgtaatggacgccaagcgtggcgtccctacaatcactttgaatatttttattacggacacacgcagtgtgtccccacttgtttaaacctatttctgacgcattgctgggaataggatcacatcacggattgacggtgcgttagcgaaaatcatcgctaagcggtcgatacctaagccttcgcctgctgttggtggtaaaccgtgttcaagggcgacaacgaaatcgtcatcgtagaacatcgcttcatcatcacccgcttcttttgctgcaacttgtgcttggaaacgttccgcttgatcttcagcatcatttaattctgagaagccgttaccgatttcacgtccgccgataaataattcaaaacggtctgtcacttctggattttcatcattacggcgtgcaagcggtgaaatttccgctgggtgagccattaagaaggtcggctgaattaattgatgctctgctacttcttcaaaaatcgcattgacgatagaacctaaaccccacgatttttggatttcgatatttaagccttttgcaattgccactgctttgtcgaaatcgtgtaggtcgtccattgaaataccgttgccatatttcacaatcgcttcgtgcattgtgatacgttcaaacggtttaccgaaatcaaacacatattcgccgtaaggcacggtcgttgtacctaaaatatctaaggctaatttgcgtaataattcttcggtgttatccattaaatcgtggtaatttgcataggcttggtagtattcaatcattgtaaattcaggattgtgacgaacagacaccccttcgttacggaagttacggtttaactcgaatacacgctcaaaaccgccaaccacaaggcgttttaagtaaagctctggggcgatacgcagatacatatccacatctaatgcgttatggtgagtaataaagggttttgccgctgcgccacctgggatcacctgcaacatcggcgtttccacttcgataaaatctttctctaagaagaattgacggatacctgataccacttttgagcggataacaaaggcacggcgagattcttcgttcgcaataagatctaaataacgctgacgatagcgagtttcttggtctgttaaccctttatgtttgtttggtaacggacgaagcgctttggtgagcagttgtaattcggctacacgaacagttaattcacctgttttggttttaaatagtgtaccttttacaccgataatatcgcctaaatctaataagcccacggtgttttcatattcaccttcaggcaaattatcgcgagccacataaagctggatctgaccacttacatcttggatagtaacaaatgtcgctttacccatcacacgacgtaacataatacgccctgcaactaccgtaggaatttctttagctttaagtgcttcgccatcgacttcatcatattttgcgtgaagatcttccgctttatcttcacgacggaatgtgttcgggaacggattaccacgctcacgcaactgagctaatttttcacggcgagcgatcatttcgccattgagatctaattcttggttttcgacttctgacattgtattaccttaagatttttaaaaataaattcggtttaattcatttaagtttgaaagggcgagattataagcgattttggaagattttggtagaaaacaagcggtaagattcgctaagtttttacaaaaaaatcaaggctggaaaaccaaccttgacttagaacattttagattaattgtgctttttgtaatgctgcagtaattactggatgatactgttcagataatactgtaagcggtaaacgtaagcacggatcactaattaatcccattttatgagctgcccatttcactggaatcggattgccctcaacaaacagatttgtatgtaaatccattaagcgttggttgatctcttctgcttcatcaaatttaccttcaagagcaagttcgcacatttttgccatatctgccgcagctaggttattagttacagaaatcacaccttgcccacctaatttcattgattctaaaccagtcgcatcatcgccacttaagaagataaaatcttcgccagcaagtgctttgatttgtgcaacacggctcagatctccagttgcttcttttactgcaacgatatttggaattttagctaaacgtgcgattgtttcaggttttaaatctgttcccgtacgacctggcacgttatataaaatttgaggtaacgatgtacattctgcaatcgctttataatgttgatataaaccttcttgggttggtttattgtagtaaggtacaacactcaaacagccagtaacaccactgtctgcaagcaattttgtcattgtaattgcttcacttgttgcgtttgaacctgtacctgcaataacaggaatgcgtcctgctgcaaattcaacggttttcttaatcactttcacattttcgtcaatacttaatgtgctacattcacccgttgtaccaacagaaacgatagcgtgtgtccccgctttaatatgaaactcaactaactcttttaatccatcaaagtcaatttctccgtgtttcattggggtaatcaaagccacaatactgcctgaaaaaagaggttttgacataattttctcctgtatatcttttttgttaaataatacgatagcttgcaaaattcggcttcaatatgcaaatgttttccaccaaaattgcaaattttttctaaaatcctaccgctattcaatgcccttttgataagacatcattacaagtgttcgccatttttcattaccatcgctgtctttccccatattcgcaatatttggaaaacgcccccaacactcaaagccgtgttttttcattaaattcatacttacttgatttaattcaaaaacatatgccatcaaagtatgaattccacgttctaacatctgttcttgcatatactggataattttcgagccatagcctttaccttttgctttttcatcaaggtaaaggctgatttctgaagtatgcacaaatgctgggcgttcataatatggggaaaagctaaaccagccgattacaccattttcatcttccactgtccataagggatatttctcactagatagatgaaattcaaaccacgctttgcgtgtttctcttgttgcaaaataaagatctgcagtcatttggtgagtcggaatcgcttgattataaatggctaaaatagcatcaaaatccgtttcaactgatttgcgaatatgcattcatagatccttttaatttagctgtaataattcatttagcgtttgagcaatactgtcttcgttatttgagccgatcacttttttcgcactttgctggacttccagctctgattcgcccattgcaatccccataccaaccagttttaacatactaatgtcgttaaaattatcaccaaaggcaatcacattctctgtgtcaatttgttcacgttttaataattctgccaaacaagcccctttgctatttcctgctttagtaatatcgacacgatctacccaagaccattcagcactcacctcaagcggtaatgtttcgacaaatttttgcattttctctaggttaggatcgctaattaacactttccaaatggttgtgtcattatcaataaaggtttggaaattttcggcttgatacacattagggcgaacattttcaggacaacttgccacccattttaagaatttggtgaaatgagcatttagcacttcataggtcatcgcatcacgagtataaacagcaacatgaatcccttctgcttttgctgaatgaattaacttttctgccaatgcattacctaacgggttagccgataacacttcatcattatgaaaatcatacaaataagtcccgttacaacagacaacaggggtatctaacccaagttctgcataataaggacgtaccgccgtatgatgacgacccgttacaatataaacctttagtcctttctcttgtgcttgcttaattgcttttttacttgattctaaaatggtgccttgacttgacagcagtgtgccgtcaaggtcgaatgcaatcgcttgataagacattacttcgctccttataaaacaaaaaaagggtcattcccttatgaattgacccttttattttactacgtcataaacatcaaagcagcaaattatttagctggattatatgaaggagtttgataaagcggagctggaccttgaggacctgcaacattaccactttcgttctgttttaatacaccaccattagctgtaatttccacacgacggtttggacgtaaacagtcacgtaatgcttgacctgattcaccatcacaagctttaacttggtttgctttaccataaccaacagcctcaatcggcactttaataccttgctctactaaacgagctttaaccatattagcacgacgttgtgacaaatctaagttatattcctcagaacctaggcgatcagtgtaacccacaagtttaaccttctctgcacctgaagattttaattgttctgcaacatcatcaacaacctctctgccctttgtagttaatatatctttatcaaaatcaaagaggaaatcaccgactaaattaaatgaagaattaccattacaaccatttggataccaaaagaaactttgcgcattcatatttttatcaaacaaaattttgaattgacaaattttgtgtacgcccttttctctatagttaaaagcatagtcccactcatgtacttcataaagtccttcagaaaaatgagggcgaccaatcaaattataaagctgatctttgttcatccctttttcaatttgacgaacattttcccaattcggccatgatccaaattgagagccatcatgattaaattttgattccgaaatttttggaaataccggtttttctgttgtaccctcatcagacaccttactcaaactaccacaagcagtaattgtaatcgctatagccgataatactccacgaaaaaaaattgtttttttcattctttaccccttaaatatcaaattaactatctcttaatatagaatattatcagaaatatctatacttctttctataataaaaacctagcataattctactatacaaaatagtcttattctatctttttttatttgaattgatcatcttctaataaatattcaataagtagttggaggttttttcctcccctaaattcattaatatccaatttataaacaaatgttgcctgtttaatagataaatcaggatagcattttacatcaacattaaaccagattgcatcgaatagcgtaccatattcattttccaccatcattttcagatgttttccagccagaagtttctgttgcaagatacgaaaccgtccttcaaacgtcggctctggaaaatgttgtccccaaggacccgcttgtttaagtaattccgctgtggctaaattaaattcatgggcgaacaactcaccgtccgtataaatcaccccttgtaaccattcaggttccgcaacttcatttactgtttcgtcaaatacagtttgaaattgagctaaatgatcttgatgaatggtcaaaccggccgccattgcgtgtccgccaaacttgacaatcaaattatcgtatttagcatcgatacgttctaataaatctcgcatatgcagcccagcaatagaacgagcagatccttttaaatattcactatcatcactttcctgagcaaatgcaataacaggacggtaaaactgatctttaatgcgagaagccaaaataccaatcaccccttgatgccaatcaggttgatataacacgataccttgtgcttgattttgctgagagagcgttggcaacttagcacaaagggctaaggcttccgctttcatctcttgctcaaattctttacgagtctgatttaatgaatccagctctagggcaaattgacgagccaatgcgagattatcggaaatcaacagctcaacccccaaagacatattctctaatcgcccagccgcattcaatcttggggcaatggcaaaccctagatcactggcttgcaaagcatagagatctcgtttagccacttctgccaatgcttgaatccctgctcggcaataccctgaacgaatacgatttaacccctgattaaccaaaatgcgattattgtgatcaagcggaacgacatctgcaactgttcctaaagcaacaagatctaataattctgcaatgttaggctctttctctttgaaatagcccagctcacgcattttagctcgcagagccatcatcacatagaaaatcaccccgacaccagccaaagactttgagggaaaagtgcaagcggtcagatttgggtttaccattgcatctgcatttggcagactgtctgcaggtaaatggtgatcggttacaagaacccgaatcccttgagctttaagtaaagcaatcccttcaaaagaagaaatgccattatctaccgttaaaacaaaatctgccccttttgcaatgaccatttccgcaacactaaggcttaagccatagccttgtgaaaagcgatcagggatcaaataatcaacctgctgaaaaccgaactgccgtagcgccaaaatcgccaaagcagtactggttgcaccatctgcgtcaaaatcccccacaatcacaatccgatcttgtcgggttaagctatctaacaataaatcaactgcttgatcaatattggcaagccccttagggtgatgtaaacctttgagagataaatccaactctgcagggctttttacccctcgactttgatagatacggtttaatagaggattttctgataatcgttgttctgttaattggggacgacgttggactaatttctgcataaaaccaaacttagttgtaataatatttatccatgctttaaagtagatatcattccgtttgcttacgatctagataatgataagactgaattttacgaatagtacgagaacgtcctcgaataagtaaggtctctgtcactgctaaatttccttgacgtagaatacccttaagcaaatctcctgaagtaatcccagtcgcagaaaaaactaaattatcatctctaactagatcttcaagcttcaatatttcattaatcggtacattcaatgcttcgcaacgatttatctctttttccgcataagcaaaattctctaaggtattgcctttaacttggttccgtggaattaatctcgcttgcatatcaccgcctaaagcacgaactgctgccgcagccacgacaccctctggggcaccaccaatgccatataacatatctaaatctgcttcaggtaaacagcactgaactgctgctgccacatcaccatcaggaatcgccatcacacgaacgcctaatttttgcatttcagcaataacctctttatggcgtggtttatctaatacagcaacggttaattgagaaagtagtttcccttttttagacgcaacacggcgtagattttgctcaataggaagacttaagtcgatcatacctttagcttcactgcctaccaccaatttttccatatacatatcaggagcttgtaaaaaggtttctttgccccctgcagctaataccgataatgcattcgcttgccccatcgctgtcatgcgagtaccatcaatcggatcaaccgcaatgctgacttcttcatcttcaggacggcataaaccaattttttcaccaatataaagcatcggagcttggtcaatttccccttctccaatcacgacttcaccacgaatttccatttgatttaacaaaaaacgcatcgcttttactgcagcatcatcggcagcattcttattgccacgaccaagccaagcaaatgcagccagtgctgccgcttctgttacacgggaaaattcgatagaaagggatcttttcattttaggttccttaaatagagatgtgtttgcaaaatttttgaggaatcctaccgcttgtaggaagttatgtgcggaatgaaattgtaggcgttagagattttttagtcaatttttatcgtaattacttgaaccattttgcgttaagcgtaatcaagtgtagaatgcaatgatatttttattaaatgagagtaaatatgagcaacgaagaaatcttaaacaacgaacatcacgatgttcgagccaactttattacccatattattgatgaagatttagcctcaggaaaacatgataacgtttatactcgtttcccaccggaaccaaatggttatttgcatatcggtcacgcaaaatctatttgcttaaacttcgggattgcagaagattacaaaggcttatgtaacctacgttttgacgatactaaccctgttaaagaagacgtagaatacgttgattcaatcaaagaagatgtgaaatggttaggctttgaatgggaaggtgagccacgttatgcgtctgattatttcgatcaactttacggctatgcgattgaattaattaacaaaggtttagcctatgttgatgaactatcgcctgatgaaatgcgtgaatatcgtggtacattaactgagccaggtaaaaacagcccatatcgtgatcgcccgattgaagaaaacttagcgttattcgagaaaatgaaaaacggcgaaatcgaagaaggaaaaatgagcttgcgtgcgaaaattgatatggcttcaccatttatcgtaatgcgtgaccctgtattgtatcgtatcaaatttgcgagccaccaccaaacaggcgataaatggtgcatttacccgatgtacgattttacccactgtatttcggacgcgattgagcgtattactcactcaatttgtacattggagttccaagataaccgccgtttgtatgactgggtattagaaaacatttcgattgaacgtccattaccgcatcagtatgaattttcacgtttaaatttagaaggcacattaacctctaaacgtaagctgttgaaattggtaaatgacggtattgttgatggttggaacgaccctcgtatgccgacaatttcgggcttacgtcgtcgtggttatacccctgcttctatccgtgaattttgccgtcgtattggtgtaacaaaacaagataacgtagtggaatacagtacgttagagtcttgtattcgtgatgacttaaataccaacgcaccgcgttcaatggctgtgattaatccggttaaagttgtgattgaaaactttgaaggcgaagagtggctaaccgcaccaaatcacccaaaccgtgaagagcttggtagccgtgaattgccgtttacccgtgaactttacattgatgaagcagacttccgtgaagaagcaaataaacagtacaaacgccttgtattaggcaaagaagtacgtttgcgtaatgcttatgtgattaaagcagaacgtgtggaaaaagatgcaagcggtaagatcactacaatttattgcacctacgatcctgaaaccttaggtaaaaaccctgcggacgggcgtaaagtgaaaggcgtaattcattgggtgtctgcggtacataataaacctgcggaattccgtatttacgaccgcttgtttaccgttgcaaatccaggggctgaagaagacatctgctctgtggtaaatccaacatcgttagtggttaaacaaggttttgttgagccaagtttagcgaatgcaaaagcagaacaaggttatcaatttgaacgtgaaggctattactgtttagacagtaaagacggcagtgcagataatcttgtctttaacttaacggtaagtttaaaagagagcgtagcgttttaaggctataaataagataagcaaataagcgggcggatagctcgcttattttgtaaattttcttgatcaaagtaaacattggctatagattttctcaaattatcacaaggagatataaatgagaaagctcacatatctaacttcacttgctatttttacaagtgctttacttggttgcagttgtagttgtgaaaaaacgcaaaaaccacaggaagagaaaaaggatgatcaggcgttgtttgaggaaacgctaaaccccacgccccctttaccaataagtctgttaaaactgcctggcccaccaacggtcaatttgttagcaaccagtccatcaaatactgccgaatttaacgactttatcagtattatgggacaaaatggggcggtgattacgatgtggtctgttgatcgtcgtagctggctttggatgtatccgccgcttaattctcaagattttggcaaattgcgtaattggcgaattgagcggagcttccgtcaagaacattttcgttttactaatcagcagatgggatcttgtatgcaggcttatggaaatggtgtgattcaagatagctgtgatccaaataatttagatcaagattttgagttactgccaacctcgacaggatcggtgttcattaaaagtgtttcccagcagcgttgcttaacttacaatgcggtgagtaccactggctattttacgctgactttggatcgttgtgatgataaacgtattacaccgttacacgatcaaaccttctatctcacaccaccattacttagtgctaatccattataggaggaaaaatgacgttatttaatcgagctatagcattagtatgttgtttacttcctcaaattgtcttggcaaatttggaaaactatacggttgcaacgtggaacttgcaaggttcttctgcgattaatgaaagtaaatggaacatcaatgttcgtcagcttttgacggggcctcaagcggcaggtattttaatggttcaagaagctggctcattgccatctaccgccgttcatacacgccgaatggttcagcccgagggggttggctttccaattgatgaatatgtgtggaacttagggacaagaagtcgtccaaataatgtttatatctattactctcgcttagatgtcggggcaaatcgagttaatcttgcgattattgctcgtcgtatggcaagcgaagtatatgtgattaactctggttctagtgtattaacctctcgtccagccataggcattcgtattgataatgatgctttctttagtattcatgctctttcatctggaggagcagattcactaagtttgattcaaaatattcatacgttctttaatactgaggaaagacgacatatcaattggatggcagtaggtgatttcaatcgttctccaggcagaatgcaagaagcattaaacacagaaccaggattaagcaatgccacattaattgttgcaccaacggaacctacccatcgttctggcaatgtattggattatgcagtgttacacaatgcgaatcaaaccacacaaaatacaacggtcagtgccagcattatgtttaatcagatgagatcgcagattacctctgatcatttcccagtcagctttgtgaaaaaacgttaagggggaactatgttaaagcgttttactttattgatgacattaggactatgccagttttcccttgcagaaacaccaccgatgccacctgcacctacgccaacaccatcaacttatcctgatgttgttgaaataaagccccctattatctctttacgcagtttaaatacgggggagccagtatctaatcggagctacgatcggaatgatccaagagaggtgcagtggagacttgtcgatgctattgttaaaaatcgtcggttcgtacaatttaaagtagttgataaagaagagcgttgcttggttggagatggtggtactttgccttgtggacaaatagacactttatttagattagtcccaacagatacaggagcatttattctgacagaacccaacacaggaaaatgtttaaccagcgagaattatggcagttatggttttcaaaactgcttgcgaacttcttcagcagaacctagcaatattccgttaaaacatctttggattattgctccgccttttggacctagtaggttattataacattacaatttttaggggctaaattgattagcccccattccaaatcagtgccttcctcaatgccataaaaaatctatcattttcctctgccaacccgatactgacacgcaaggtttgcatgccataacctgcatccaaactattacaattaaacggctgactcaaatcgtatcccaatcttttgctgggatttaacgtgctatctcatcaatctctttagggacaagcagaataagcaaattttgtacagatatcaatcaattaaaatttatttctatttagtaggataaatttcatttgacagcgaaataataaaacgttatttctatgcacgtttttcgtggcttacgaaagaaagttataatgcaaattatagcgggagaggtgcaacactcagatagcttattttagggaactagaccgtttgaagaataagtaacgggggtgattgccgaggtgtgaattcactagataggaatgatcatcggctgtataggttgaatcttatcagctgtcgtttaacaaccgttaagcggagtgctcttaaatttgtttttcaacaaaccaaaagtaactcaaaaatcccatttcctatctttttcacttcattgcaaacacaattttatttataggaaattttcatgtctcatctttctgttgctaaatttggtggaactagcgttgccaattttgaagcaatgtctgcctgtgcaaatatcgttactacagacgcaaatactcgggttgttgtgttatctgcttccgcaggtgtgacaaactatttagttgagctggcgaatggttgtgaaacagagcgtcgtgaagaaattttagcggcagttcgtaccattcaatacaacattatcgaaaaattacaagaccctactgcagtttctgcggaaattgacgcattattagaacacatttcagcccttgccctctctgcaagccttgcaacctcagcagcactgaccgatgagttaatttgtcacggcgaaatgatgtctactaaaatcttcactcagctattaaaagagcgtaattatcctgcggtgtgggttgatgtgagagagattgtagctaccaataaccattacggcaaagctgcaccaaacgatgagaaaacccaagctcagtcagatgcaatccttaagccattaattgcagaaggcaaagtcgttattactcaaggctttatcggtcgtgatgatgaaggcaaaacaaccacattaggacgtggcggtagtgactattcagcagcgctattagcagaagtattaaatgcaaacgatgtgttaatttggactgatgtaccaggtatttacaccaccgatcctcgtgttgtaccagcagcaaaacgcattgatacaatgagctttaacgaagccgcagaaatggcaactttcggtgctaaagttttacacccagcgaccttgttgcctgcggtgcgtagtaatattccagtatatgttggctcaagtaaagccccagaacaaggtggtacttgggtaactcgagatccacaacctcgcccaaccttccgtgcattagcactgcgtcgcaatcaaattttgcttacgctttcaagcctcagcatgttacacgcccaaggcttcttagccaatgtctttgcgattttagcaaaacacaaaatctctgttgatgtgattacgacatcagaagttagcattgcattaacgttagataaaacaggttcagcatcgtcaggtgcagatatgttatcccctgaattattggaagagttacgccaatattgcaatgtgaaagtagaaaacgatcttgctttagtggcaattattggaaacaacctacatacacaagcgggtattgcgaaacaattatttgcaacactctcaccatataacgttcgcttaatcagctatggtgcaagcacaaataatgtatgtaccttagtacaaaatagtaaagcagatgatgtaattcgttcgctacattttgcgttgtttgaataattggctcgccatcgacgagcctctcccacaatttgtgtaaatacctgtttctgagataatacattcagacacaggtattttattatgaacgaaaaacaacttcacgccttggcagcggaatttgccaattaccattaaaacggcacagcacattaatttccccttgaatttgggtaagttcaataaggcggtcaagatagtccatcatttttcattaatacaataagcatgagctatctcaacttcatctgaaaaatcaccgcttccgcttggcaactaaataagaatttcgcttgtaacaaaaagccatcttcggtttggctgatttggctactgatattgcacggatcgctttcaacttctcttgcttttgccgttaatgtggccagtccttgttctgcatctgcttgggttggatagacaagggctaattcaatggtgctgtccgcattgtcgaacatagacgtgctacttggtttacaaataccaccacaacaattggcttggtcactaaaggtttttgacatatttactccttgatattttgaaatttaagtaaagcgtatcataatatggtaatcaattcattgaggggaaacaaattatgtctatttctaaacaagctattcttgatgccttccattatcgccatgcttgcaagcaatacgatccaacgaaaaaaatcagtgatgaagatttccaatttattttggaaacagggcgtttatcgccaagttcttttggctttgagccgtggcgatttttagtgattgaaaaccacgctatccgtgagcttattcgtgataatgcgtggggggcaaaggataaggtgatggattgtagccattttgttgtgatccttgttcgtcagcctgaaactctgcttgctgacggcgaatatgtacaacatattatgcgagatgttcaccatattcctgaagaagcgttaaaaatgcgtcaaggtttttatcgtaacttcagtgaaaaggattttggcttgacccaagatcctgtggcgttttatcactgggcttgtcgccaaagctatattgcattagccaatatgctaacagcttcagcaatgattggcattgatagcaccgcgattgaaggtttcccattggaaaaaatggatcagctttttgtcgaaaaagggttgtatgatccgaaagtctataaacttagtgtgatggtcgcctttggttatcgtgcggtagaacctaaagcgaagacccgtcaagcaatctctgatgtggtggaatacatagaataatgcttcttaatacaccaatcctaatatatccgaattaatatacctatgataatatccactacaaatatctaccttgtcggtggtgcagtacgggatcaactactcggcttagcagtcaaagatcgtgattggttgattgttggggcaacacccgaacagcttttagctcaaggctatcaacaagtcggtaacgatttccccgtatttttacaccctaaaaccaaagaagaatacgcccttgcccgtaccgaacgcaaaaacggcaatggctataacggttttatctgcgactttacccctgaggttactcttgaacaagatttaatccgccgagatcttaccattaatgcgattgctcaagatcttgacggcaactaccacgatttttacggggggattgccgatcttaaacatcgcctgcttcgccacgtttcccctgcctttgccgaagatccgctacgggtgttgcgtgtggctcgctttgccgcgcgcttccattctctcggatttcggattgctcctgaaacggtaaaattaatgcaagaaatgaccgcttgcggtgagttagctcatttaacagcggagcgtgtttggctggaaacccaaaaagccttcgccaccgacacgccacacatctatttccaagtgctacgagaagtcggggcattgaaagtgctatttcctgaagtggaagcactctttggcgttccacaacctgaaaaatatcaccctgaaattgatagtggcgttcataccttgatggttttggagcaggcgaaaaaattagcggttcaagcaaatgatcctgaaagtgtgttatttgccgcactctgtcacgatcttggcaaagctctaaccccaaaggatattctgccccatcattatggacacgaacagaaaggcgttgccccaacagagcaactggcaaatcgcttgaaagtgcaagctcacactaaagcattcgctaaactggtgacggaatttcacacccatagccataaaatcacagagctacgccctgaaaccgtggtgaaattgtttaataaacttgatgtatggcgtaaacccgaacgtttttttgattttttattggtttgcgaagcggatagcaaagggcgtttgggctttgaaaatcgggaatacccacaagcggattatgcaaaacagctctatcaagtcgcttgtgaagtggatattcaagcggtgattaacgatggcttcgagaaagcggggattaaaagagaaattgatcacagaagacagctagttatcctagctaggaaagaggaaaacctgaactgtaagaagccaaaaacatagctaaataaagtagctttaatcccctactctccaagacttaaagctacttttgtctactaaaccttcccaaaccccttcaatccaacaacgtgtacatactcttggttattggtgatcttacgcactaacttgtaggttgtaccacgttctgggctgatgttttctggggcggcgataagcaactgcatatccaaacgctcacagagttcaaacaaggtattgatcgaggttgcgtctaaacgagctgcttcgtcaaggaagagcaagcgagcaggcagaatatccttagcacgcatacggcgagattcttcttcccaactttgcaccaccattaacaagatcgacatacctgtaccaatcgcttctcctgtcgataacgcactactttccgcacgcatccaaccgtctgcaccacggaaggtttcaacttccagatcgagataattacggtagtccaatagctcttcgccaatggtctgcgatgtacgttgccctagttcaatatgtggattaacacgtttgtagagcattgccaacgcttctgagaaactgagtttttggttctcaaacagatcgctatgttgctcacggtcgtttgataaggcgttgagtaaaattgcgtgggtatcacgaatgtttaccaccaaacgcacccctttcacctgaccgaacgcaatattttgcaagccttggttcagttgcaaaatacggttttgttcacgttgaatggttttacgcaagatatttgccacactttctgagctgatcgccaattttttctcacggctagtcagttcattagttaagcgagatagctcgatttccatctgttcaatcgcatcaatcggatcgtccgttttgatgatgtcttggcgaatacgctcacgcaaatgctgataaaccgaaataaagaacgccactttattttcaggcttacggctatcttctgacgcacgcaagctatcacgcaagtattcgttatccgccactgcggttcgcaacgcaccaagggctttatcggaaatcgaacgcaactcttccgccgattgataagccagctcacggcgatttaagcgtttttctacatcactattgcgagagagtttcaacaccaaacaccaactcactttcgcctgcaccacaatttcacgctgagtatggtaatcacgctctgctttacgcaccgctttattgagattatccatttccgcttgaataaccgccacttgcttatcaatataagatttacgcatacggtgttggcttaaacgttgttgcaattcatcacggcgtattctcgcacgctcttctgccccatcatcattgcggataccgtattcgtccatctcttgcaacaactcttgaagcatctgatttttcgcatcaaaggcactgcgtaacgacgttaaaacttggttatattcgctaaattgtgctgtcgcttggcgaagctgttcacgagcctgctcacgctcacgttgtgcattgtctaaacgttggcgaagctgttcgttaagagcagaaccttccgcccctactgtttcttgatagctgaaatgcaaacggcggttcatcacatcagcaagggcaaagactttctgctgttgcaatttttgttgctcaacagaccgcttgtaatccgcttgtagctgttcaaactgggtcggatcgctctttaacgccaccgcaatcggctcaagttgtgctaacgcattaccgaattgacggataaattgttcatcttcttgggcttctaacagctgttcacggcactcttccacacgatcttgtaaggtttcatcggcaagaatgttgagttgtggcaacactttattcaacagttgcaactgtgctttgctgttttccagctggtgacgtaattgctgttccgtaccgcttgcttgattgagttcacgctcaatttcagctcgtttttgtgcaatctcttgcattgccacttcaggatcaggctggaaagctaaagctaaatgcgtaccaacaaactggcttaaatgttggtgtaaacgttggcatttctgcacatcaaaggcacgttctgcgtgtttttctgtcgtttcatcacgttctgcttttactttctcaagctgtttctcacgagaagcacggccaaagaccgcaaattcagagaacttagagtaacgccattgacggtcagacagttgcactaccacgccatcgcccagttcttccgatttaaagacattatcgtcaaaggcattcggatcaccttcgatcaaatagagattttcaggacaatcatcaagttgctgtaattgtgctttaaccgcttccaaatcacgcaccacaatagcgtggcgagcatcgccatagagtgcggagaaataaggtgcatcttcaatcgacacatcttcatataactctgaaatcagcacaccgccaaatttttccgccagctgatttaagcgaatatcttccgcgccgtcaggctggcttaggcgtgaaatttgctcatctaataactgttcacggcgagcaagttcatcacgttcaagggttgcttcacgctcacggcttaaggtattttgcataaactgcataaccgcttggctactgtcaaaggtttcgccacactgctcttgcaagcgggctaatgccgattgtgccgtatgccacgcaggtgcagcttgtgcaagttgttgatattgttgatttaattgctcacgttgctgacgttgtgttgaacgtacttcaacaaattcagccagatccgcttccaaatcttcaagacgagcttgttgctcttcataatagctttcaagatcttctgcatcttccaactctgcttgtgctttttgattaaactcagcaagcaaacgttctgcattatgttgttgatgtaaacgctgttctaattctgtcaatttttgacgcaaagccaccgcttgttgtgcgtgggctttttggcttggatacgcactcagcaattcacgggcaacgctgtctgcttgtaagcggtcagtttcccctgcaattttgcaaacaagttcataggctttatcaaactggcttttcgccatatcggacactgataaacgctgttcaagctcaaacaccttgtcggtgatttcgtcagcttgagccacaaattcagcgtgataatcttcgacattgtgtaaatctaaattagccagtccgctgatctgtttcgctttttctaacgcatttaccgcttgctgatattgcaatgctcgagtttgctgtgcgtccaacgcctgttgataatccgccatttgagaacgcaattcttcaacttgatcttcggcttctgttgcacgagcttgagccatctcttgacgttccgccacttcttccaacgccatttgttgttcttctaggcgttcatttagctctgcaacatcatcttgataacgttccactttttcttgatgacgaaccgcattcatcactaaattgagatgatcggaagcactattgtactcggcttcaagactactttcgccctgttccagatcttgcatttcacggctaaattcaaccaaacgttgctgttcaagggttaatttagatttagactgataccactcttgacgcttttcaatcgcctgttgcacattgccacggcgttcgttggcgtgtcgcatatagtctgccgacacataattagtggactcggtaatcagctttttgaacatatcccgatctgactgcgtaaccttgattgcctcaagggtcatacggttttcacgcaatgccgactccatatcctgaaaggcttggcgaacgccagtattttcaggcaaaagataatcatgcaaagatttggtaataacgctagaaataccgccgtaaagggaagcctcaatcaacttatagaacttgctacggtcgcctgatgtgcgtaaacgttttggaataacgccaagatcaaagagaaaactatgataatcggtaatcgaatggtactgtttaaattgcacctcactaccatcaaatttctcttttagatcatttaacgccagcactcgtgcatttttctcaccaacctgctcagttaaaatagagataaccgattgattttcattgatattttgtaatgaaaacgaacgaatatcgactttcttatcacgccctgcgatctgctgtaaacgcacaccactaatcacacgttgtccacgggaattttcgctttccaacaccgcataacaaacgcctgctttcaatttaccgtacaaccctttatcacgagagctagaagttgaacctgcttcggtggtattacggaagttaagcaaggtgagatcaggaattaacgccgtcacaaacccagccatcgtggtcgatttacccgccccgttaccgcctgaaagggtcgttaccagttcgtccaagtcaaaggttcgagcaaaaaaaccgttccagttgattaaggttagggaacggaatttgccacgcacaacagcatcttggcgttcatttcggataacagccggggaaatttgttcattattttgcaatgtgaaatccgtgttttccatcaggatttttcctctgttcgatttaattctgtattaataatggtcgcaagttgcgtaattgatgtcgtattaagatcaaagagttttgacgttcgagaataaacttcaaaataatcaggctttccttctcttaaaactcgttccgcatttaaagcaagctgtgcaacgacaacatcaaaatgctctcttggtacataccgaggctgaataccgctacgttgttgttcttctgctcgctttaatgtacttagccaactgacctcttttgggcaagtacaaatcaacacggcggttttatagccttgctgcttaaataaatttagttcatttaatggaatatcggcggtacgaaaagtgccttcaattaacacattaaaacggtgcttaatcgcctcgttgcgaatactctgtaccattttcccagtaaattcagccgtatattttgctgcttcttttccatatttttggtaaatttcgtgatattgttgatgataggggcgaaattcatctccattgataatcaataaatcaaaatttaaccgcttactcatttcaagcgtaccaaaagattttccagcaccaggctgcctacctagaagaatgacaataggctctttctggggtgtaatgtgattttctgccattaaatttgcccaaattttggcaaacttactttctacatccgcattaacatcataatcttgcataagatcgccctagatcaacggcaaagaatgatatttatcgctaatttgctttacctgagttgaaagcagttgaaaatcgagaacatctggttctgagcgataaatttcacttctcaatcggcttaaataaatttgatcatcatttaaaggcaattccagacgtttactcaaatcagcctgtgccgttgcgattaactcgatcaagacatctttttgcattaaggtacacatctactcttcctcaccattcaattcttcttcatttgcaaattcttcgtcaaaactgaccgcttgttctttaatagcggtagggtttgtcgcctcaccatcacgaattaaacgaagttgagcttcacgaggatcgtcccctgttctcacatcagcgccaaaacggaacactgactctgaaatcacaaattttttgctgttttgatcgccaacacgagtaatcatacccaaacgacctaaacggcgtaatgcaccgcccactttctcagctaacttcgctttgtctaaatctgatcctgttgaacgtggattgattgctttaagcaacttggtttcgtccgccaaattaagcaactcatcgtacacttcgtcatagtggaaaatcccttgctgtgcaaggcgttctggactgagatagagataacacaacacttttcctaccaacatttccatttcagacatcgccgaacgagcaatcaaggtacttgccttaggtcgaagatagaaaaagccttcaggcgcacgaataagctcgacgtgataacggcgataaaactgttcaagctcgctttggtaatccatcaaaaaagcgtgttcatcaagggcttctaaactaatatgtcgccctgctcttaattgactgtcaagttgcggaaaaatcgggttagcaatcgcttcagccaatttggttgagataagttcttgggtgtttgtcattgtcgttctctatttttgtaaaactttaattaaaactgaccgcttgttatttattgtattggtcaatcacattcgcctgtacttctgcgcctttatcattaatcgactgccattctgggtaaatcgcttggctgtcttggcttgccataccgagtttaacggcttgatcgacgataattcttgctacatcaaaatggcgagaaagcggatacattgccaactgttcacgcaaaatcgcaccgagatcaatcggtttgccttgttcacggaatgggacaagatattcttgcattgctgcaataatctgctcctgcacttgggtgagggactcatattctagctcagtcggtagctcgcctacggcttccgcttcatttaattcggtttcatcatcacgcagatccatcaaaggctctgctttggcaatgtaaagttgccacgggctttcaaaataatcttgaatagactggcgtaaacgttgcccaaagacacgatttttatccatatcaatggcggtacggataaatttatggacgtggcggtcatagccgatccagagatcgatcgcctgttgtccccaactaataatgcggtcaagtttattctgcaagttcacaatcagctgatcgacaaaatccaaatcatcacgcccaatcaagcaactttgaatacgcaataattgggattgcaacttatcccctgacgcatttaatacatcttgtagctcacgcaaattccccgaagtttcgtctaacaactgctgacaagtcgcaatggcttcgtgccaattttggcttaacagtgcagcaatacgctcacggatctgctgctgattttcgtccatcatacgctgggaaagatcaatgctgtcaaaaatttctgcaaccgagaattttaatggggcaaacacttgattacgccagaaacgttcatcaccaccttcttctgctgcattagaggcgcgctgaatttcatcggcaacaatagaaagttggatcgatagacgtaaagtcgaaaattcacgttggcgaatgtaatactctgatacgccaacaccaagtggtgttaagcgataaattgccaaaccttcggtaaattcgctcgaaaaacggtttaaaaaacgttgtttgacaagatcgttgatcgcattattcgcgcgctgtgtttgtgttgcttcagactgctcaaaggcatttgaaacatgacggaaaatatcttgtaaatcggtttcaagcaattcaccgtcagtgcgttcgttattatacagggctatcgccaataaaaatgccaagcggtcggaagaaagggaaagcgaaaattctcgctcttttgtccataaaatcagttctgggatcgtttgtgctaattcgtgttgcataggcgatattatttaaacataaaaataggcgttattgtaccttaatcagagcagaatggaaaagacaagcggtgagatttgtacaatttattacagttctcgccgcttataggctattaactaaattatctcaataaatattggatcattaaacctgcaacatctactttagtcacctgttcaatcatttcaagcccagggcttgcattgacttctaacaccataatgccttgttgagaacgaataagatcgacacctgccacatctaagccgatggcttttgctgcttgaactgcgattttttgttctgcatcagacagttgaatggcttgggcggtgccacctctgtgaatattggctctaaactcaccgcttgcaccagtgcgttccattgttgcaacaacttgatcgccaatcacaaaagctcgaatatcttgtcctttggactccgcaataaaggtttgtaagaggcttggtactttggcattttttaatgtttcaagtaaactcaaggcaccgctgtggttttctgccaacattacccctacaccttgagagcctgacagcgttttaataaccgctggcaagcctgattgacttaaaccttcagcaacgctgtaaagctctcccattaatagcgtatcaggtactggaatgccacaggcggcaagtcgctgtaggctttgccatttgtcacgagcgagtgcaaaagctgaagatgaatttaaaatgggtatctgtttttgttcaaaatgccgtaatacattacagcctatttctgtgctagttgtaccaaatcgaggcaagatacctgcatattccccgattttttcgggttttgctcgagttttgtcgtagctttccccagtttgataataaagctcgaaccgctcttgctgcagttgtagcaagaagcggtttggatcgagaatatccagttggtagccattctgttctgccgcttgtttaagtctttgacaactatataaacgaggctcacaacagagaattaataattttttagcattcattatgcgtaaggctgtaactcagggttaattggtgtgtctgcgaggttgtttgcataattacacaaactagctagactaacaccaagtaccacatctagggcgttttgttgggtgtaacctacagcaaaaaattcattaagtagcgtttcgccaactttgcctttagtgttgataactgagagtgtaaagcgtgcaagggtatctaatttgttatcttgaattggcgtagctttgcgtaatgcttgcagtaattcgtcaggcattttgatctgtttaatggaaattgcggtatgccctgctacgcagaaaccacaaccatttgcgaccgctgcggtaatttgtacaacttctctctctgttggcgttaagctggtgcgttggttaattgccccgacggtgcgataagtttctaatgcggtaggtgcatttgctaatacgccgattaggttaggaatgaagccgttattatttttaaccgcttgtaatgcttcttttgctgcttcaggtgcagtgtcgatagtatgaatttgaaatttagacatagtgaacctctgtaataaaaaataaaatctgtcaaaaatttgcgattaatctaccgcttgtaaaatgttttttaattgtatgagatagtctattacccccttggaattacccccccaaaatagccctgagtgtcagggctaatagctacaatttttctaaataatttattccgccaagattattgacctgtcgaataatccactgttgccgagctcgcattgtttggcttggcattttaacccgataaatcatcggatttggcaaagaggctgctaataaggaagcctcgtgtaaactaagctggcttgctgatttcttaaaataatgtttagctgccgcttctacaccaaagatgccatctccaaattcagcaatattgagatagacttctaacactcgctgtttatcccaaagtaattccactaaaaaggtcaaaggcacttcgatcccttttcttagccaacttgttccgtgccataagtaaaggttctttaccgtttgctgagaaatagtggaagcaccgcgaggtttcttttgagatttactatttcgcttaattgctgcttcaatcgcatcaaaatcaatcccaaaatgaattggaaatttttgatcttccccagcaataaccgacatttgcatttgccacgaaatacgatcaagactaacccactgatattgaattttatataagtccccttgtattaggtgttccacttttttctgtagcatataagctgaaaaaggaactggaatcgcagaaaatatcaatgttaaagaaacatagaaagttgtgactgccacaccaatacgactaacgccaaaccaaagccaactttttaaggataacatctgtttgggaataaaaaagcggaaaatagattgtagcaaggatttttgcttaggttttggtgccattcagttttgtatctatccactttaaaatatctggctcaacagtttttaacatatttgaaccccgtgtaatagtcgccgcactagtattcaattgctgttggatttcacgctgagaaatttgattttcgagcaatgcgcgtacaatttgcactcgcaatcccaacgaagttcgttcgtctgttgtcaataacatcgacaataatgcatctgttttatcttctgctaccgcttgttttaaaaggtcaacaaattgttgccattcttttggatcacgttgttgataaagggttctcatacttacttatcctgttagtacaatagtacggtaagatctgcaaatcttaccgctttactctttgttatgcttattttttaccacgttgatcgtctaattcagccccttttggcatactaaaactaaacagactttcagataaatgagccgttgaaatgttgcgtaatacatagagattactttgtccgtcacgttcaatagtgctaaaacctttgactaagccacttgcatcaatacgaatatcaaattgtttgatcgcactttttttcgattttggttttaatacaaaattatctacattttgtgtgacatcatattgatcccaatggcttttatcattgcttgttaaaagtacaaatggtgtgttgctcacagcatctttaacccaatttgccgttacctgagatacaaaaggatcgtaaaaccacaaagttttgccatcagatacaattaaattttcttgaggactttgggtgtccatacgaaataagttcggacgtttaacttgaaacttcccttgccctttttgaatttcctttcctttacttgaacgaacggtctgttcaaaatctgcactgtattgcattgctttatctaaacgttgttgtaactctgcgacagcttgagcatcagcaaaagcaaagccatttaatgagagaaatgctaaacctagcaacgatttttttaacaaatttttcattgatttccctttaaatatctatagaaaagtgtctatttgacagcaaagccataaaaagttcttagaaacggatacccgtaccgattcctaagccaataccgactccattagaaccaccacctgcattcactcttccaccaaaagtacaacctgcgagcattaaaatagaggcaatcacgaatatttttttcatatttatccctttgtattaaaaactattataaactttcagcttcaaaagatgcgcattctactctgttttaacactttaaaccaattccaaaggagattttatgaaacttttacataaactaagcttactctttttgataatttttcctatgactactcaagcgagtccgttgagtatttcagagcaagaaatcaatcaatatttggctacgcgtttagcagaaaaagtgcctttgcaagatagtttaggtgtaccaagactatttcaactagactataaattatctgatttatatacaaaggtgggacaaacagatgaaaaggttgttgatatttcaggcatcatcgacagtctattacagataaagggtaaagaatatcaagttaaacttaatataaatatggatactcttcctttctatgatatggaaaaaggtgcactatttctaaaaaatgttcgtttaaaaaattggaacgctacccctgaaaaatatcaaaatgaacttcaggtgtttttaccaataattgctgatggtcttacaaatatcttaaatagccaccctgtttatacattagatgaacgcaaaacaaaagaatcccttgtaaaaaaatttggaaaacatattattgttgaaaaaggacatattcgtttagaaacaaatattttttgataaagatccctcttattttaaataagagggattttgcattctattcctttaaaaaaccttccaacaattcatttaaaaataatttgccgtgctgtgtaatctgccaatatgtattgttttctgtgataaaatttttgctcaatgcccaatccattgtagcttgaacctttttccgatctagccccgtatatgcctcaaattctgtttttggggttgcttcaagtaagcgaaaacggttcataaaaaattcaaaagggcgatcatcattttcaatcatctcttgatgataacgatattcccctcgcatatagcctttcgggtgtttagttttgctaaagcggtaaatttcccctgttggataacttattttcccgtgagccccacagccaatcgctaagtaatcaccaaatcgccaataattcaaattatgctgacattgatacccctttttcgcataagcagaagtttcatactgttcataacctgcgtcagttaaaagctgatgcccttgttcaaaaatatcccaaagctcatcatcgtcaggtaatgtgggctgtcgatagtaaaacatcgtattcggctcaatcgtcaattgataccacgaaagatgtggtggatttaacgcaataccttgccgtaaatcatcaagagactgagcaacagattgatttggcaatccgtgcattaaatctatgttgaaacttctcaggcctactcttgctgaattttgagcaaatctaaccgcttgttttgcttcattgctatcgtgaatacgccctaatttcaataatttctctggttcaaaactttgaatacccattgaaatacggttcacgccaccttgtacatacccgataaaacgttctgcctcagcagtccccggattagcctctagggtaatttcgcattcgtgagaaaaatctatccgcttgcgaatttctgcaagtaaataatgaataccttcagcggaaaaaagactaggcgtaccgccaccaataaaaattgagtggatcttgcgatcagcgattgctgttttatagcttatgagatcttgctcaagatcattgagcaaatgctgaatatattcttgctcaggaataatgcccttttgtgcgtgggaattgaaatcacaataggggcatttttgtacacaccaagggatatggatgtataggcttaaggggggctgcattaaattcaccatatcttccagtacataaaatccaaataaaaattcttacatatagtactagtataacacctaagatatcacaaagctttccttatcaatataaaatcagtctccttaaaaaattaggatgattgttcacatatacaattatgcctacctatttttaaaataacctattaatttgatttactatccagataatctcaaacacccaactctttaaacaaccgtctgcaagctgtgccatcttctttaaataagtggcaacggtttgggttgataccaattgacatttcatcaccttcttcaactaatacgatgtcgttttggcgataaacaaggctttgtttgattggtggcatttcaaggtaaatttgggtttcgtttccaagttgctccacgacttttactgttcctttaatgcacacttcactctgatcacaaggtagtaaatgctctggacgaatacctaaagagatattgtcgccgatattcacacctgtgttatctactgggatccagaagttgagatgggtggagtcaggtaattcaatttttaccccaccttctcttacatcaatcacttttacaggtaagaagttcatttttggtgaaccgataaagccagcaacaaagcggttggctgggtagtgataaagttctaatggtttaccaacttgagcaacgttagtggtaatttgtgtattgtttccgagcgcttgtaacaccacgattttatcggcaagggtcattgcttccacttggtcgtgggtgacataaatcattgttctacctaattttttatgcagtttggaaatttccacacgcatttgtacacgaagggctgcatcaaggtttgagagcggttcgtctaataaaaacacttcaggttgagaaacaagcgtacgaccaatcgctacacgctgacgctgaccgccagagagttccttcggtttacgttgtagtaagtgagcaagttggagaatttctgcgacttgatttactcgttgctcgatttctgctttcgctttacctgccagttttaagccgaaggacatattttcagccacattcagatgtggataaagtgcgtaagactggaaaaccattccgatattacgttgagcaggtggcacatcattcattcgggtatcaccaataaagagatcgcctgatgtaatatcttccaagcctgcaatcatacgcaatagggtggatttaccacagccagatgggcctacaaatacgacaaattccccttctttaatatcaaggttaatattgcgtgagatatgcacatcgccgtatgatttatttacaccaataatttttacatctgccattgtcttatcctttgccttagggttactactttttgataggtgccaagattacttatttcctcttgtcttgaaatcatactttgtgaaaaaatttttcactaccttgtaaaaaattttttcgcagaaaaccagattttttgtgacttagatcacaaattcatacgctttttttgtgatctctttcacacttattttaaaaacgatcaaaaatgtgatacagatcactaaaaggataaggggggatgataagggggtatgatgaagtatgagaagaaatcctccactattcgactgtcaaaatttcatttcactaaactgagggaaaaacaatgaaaaaattaaccaaagcagcattagcggtattagtaggattatgtatcgcacaaggtgtaaatgcaaaattagttgaaggacaactcaacatctggatcaatgccgataaaggttataacggcttagcagaagtgggtaaaaaatttgaagcagaaacaggggtaaaagttgttgttgaacacccaagcaaattagaagaattattcccacaggttgcggcaactggtgatggtcctgatattgtgatctttgctcacgaccgttttggtggctatgctcaatcaggcttattagcagaagttcacccaagtgcagaattcaaagcaaaattatctgatatcggttgggaagctacaaaatataatggtaaacagatcgcttacccgattgccgttgagtcgctctcattgatttataataaagatttagtaccaaatccaccaaaaacttgggaagaagtggagaaattagataaagatctcaaagcgaaaggcaaaaatgcgattatgtggaacttagcagaaccgtatttcacttggccaatcatctcttctcaaggtgcttatgcgtttaaagtgaccgcaaacggctatgatgcaaaagacatcggtgtaaataatgaagctgcacaaaaaggcttacaatttgtggttgatttagtgaagaaaaaagtcatcaacgcagacaccgattattctgtggctgaagcttctttcaataaaggcgaaacggcaatgactatcaatggtccgtggtcttgggcaaacattgagaaaagcggtattaactatggcgtagccgtactaccaaccttaaacggtaaagcaggtaaaccgttcgttggcgtattaagtgcagcggtaaatgcatctagcccgaaccaagacttagcgaaagagttcttagaaaaccacttattaacggatgctggtttagaaaccgtgaataaagatacgccgttaggtgcagtagcacttaagagctaccaagcaaaattagcggcagatccacgtatcgcagcaacaatggcgaatgcggaaaatggtgagattatgccaaacattccacaaatgagccgtttctggtattcagaaaaagcagcgattgacagtgcaatcaacggtcgccaatctgttaaagccgcattagatgaagcacaagcgaagattgaaaaagagtaatttttaataaataaaaaatgtagggacacactgcgtgtgtccgttaaataatccaaattagacggacacaagcagactagtggacacacgcagtgtgtccctacgagtatcaagcggtcacattcttctcattttttgcaatttcctcttcgcagtactaaaacaaggaaaataaaatgctaacttcaactcattcctcgatttcgtctgctcaactttggggcaaaagggcttttgtcggattactttacctacttgctttttacttggtttttacaatttatctgcaaggtgaaattttatttgcattactaaccttagtcgtagtggcttcaggtatttttgtgtttagctcagaacgggcttatcgctggcgttatctgttcccaggcatatccgcaatcggcatatttgtagtctttccacttgtctgtactgttgttatcgcttttactaattacagcggttcaaaccagctcgcctttgaacgtgtggttaatcaattgcaaagccaacgctatttttcaggcgaacgttacgatttcaaattacttgaaacagcggataatcaatatcagcttgcccttgaaaataaaaatgtgcaaaaaacttacctttctgcaccgcttgcactagccgatttaaaaggggaaatcaaattagaagaagtggcaacattgccagaaagcaaagttgcaccgtttaaaaccattacccaaaatcgccaacaacttcaaacggtgaatgcgattttaccaagcgaagaaatgctcacgatgagttcacttcgtcaattttctcaacaaagctaccgctttagctttgatgcagagagccaaattttaaccaaccacgaaaccaatgaacgttataaacccaatgatgatgtcggtttctttgagcaaattgatgagcaaggtaactttacgggtaaacgtgttgagccgggttatacagtagcaattggctggcaaaacttcgtgaaaatcttaacggacgaaggtgtacaaaaaccctttattcaaatctttatttggacagttacctttgcattcttaactgtcgtgtttaccacattactcggtatgattttcgcctctctagtacaatgggaagcgttaaaaggcaaagcggtttatcgtttactgttaatcctgccttatgcggtaccaggttttatctctatccttgtatttaaaggtttatttaaccaaagtttcggcgagatcaacttaattttaaataacttattcggcattcgcccagaatggtttaacgatccattccttgctagagtgatgttgttaattgtgaatacttggttgggttatccttatatgatgattgtttgtatgggtttactcaaagcgatcccaacggacttatacgaagcctcagcgattgatggtgcatcggtatggcaaaacttcaccaaaatcacaatgccgttgttaattaagccgttaatgccattgatgattgcgagttttgccttcaacttcaataacttcgtgttaatccaattattaacccaaggtcgcccgtcaatgatcggaaccagcacaccggcaggacataccgacttgttagtgagctacacctaccgtatcgcctttgaaggtagcggtacgcaagacttcggtttagcggcggcaatcgcagtaatcatcttcttactcgtcagcggattagcgttgttccaaattcgtttgactaaattacaacaggattaagggggataaaatggctatcgttcaacctaaatcaatgaaagctcgcttatttgcaacgcatttctttcttattgtgttctgtgcgttgattatgttccctttactgatgattttagggatctcacttcgcccgggcaacttggcattaggggaaattatcccaagccaaatttcccttgaacactggaaactggcactcggttttagcgtcaccaatgcggacggcactgttactccgccgccattccctgtactactttggttatggaactcagtgaaagtcgcaggtgtcacggcaattattactctagcactttccactacggcagcttacgctttcgcacgtttacgctttgcagggaaatcaatgctgttacaaagtatgttgattttccaaatgttcccagcggtactttcacttgtggcgttatatgcattatttgaccgcttaggaacctatgtgccattcttgggcttaaatacccacggcggtgtaatcttcgcttaccttggcggtatcgcaatgcacgtttggacgatcaaaggctattttgaaaccattgataaatcgctcgaagaagcagccgcacttgacggtgcaaccccatggcagacattccgtttgattttattaccattgtcagtgccaattttagctgtggtgttcattcttgcctttatctcggcaattatcgaagtgcctgttgcctctctcttattgcgtgatgtggaaaactacacccttgcggtcggaatgcaacaatatctacacccacaaaactacctatggggagatttcgcagcggcagcgattttatccgccattccaattaccttagtctttatcatcgcacagcgttggttagtcggcggattaacggcaggtggggtaaaaggataaaataaaattgtagggacacactgcgtgtgtccgctattcaaacgaaaaataatcaaatggacacacgcagtgtgtccctacaaaaaataataccattcgggaaacaataacaatgaaacaaaatcacccatttttaaatcgttacttcgtggatgaacacggtcgccgtgtttatgcccaaccgtccgtttatggcaaagtggcaaaattgctcggtttgcaaaaaagtcgcaaaatcctaccgcttgtcaaagttgtcaaacagggcgagcaagtttttattccgctttttgtagcggacaaaacccaaaccattcacgcaaactggacgctgacccttgaaagcggtgagattttaacgggaaaatgcaaacgcaatagcattgacctgcctcgtgatttaccccttggttatcatcaattaagcctgaacggcacaaccgcagaatgtcgcattatcgttacgcctgaacgtgcttaccaaccgcaagagttggcagagcataaaaaattatggggagcaattttacagctttacaccctacgttcagagcaaaactgggggatcggcgatttcggcgatttagcggagtttttaacgaaattagcggaaaaaggcggtgattttgtcggcttaaacccaattcattcattattcccagctaatcctgaaggagcaagcccttacagcccctcttctcgtttatggcaaaacattgcttacatcaacgttggggcgattgacgctttccaacaaagccgtgaagcacaagcgtggtttaattcggcggatattcagcgccaattacacgaagctcgccaaaaagattatgtcgattattcacaagtgatgtggctgaaattacaaggcttacgcttagcctacgaacaatttaaacagcaagatcaaaccgctttcgaacaatttattgctgaaaacggcgaagccttgaaagtgcaaggtacttttgatgctctacatcaatggctttcttctcaattctgcgaacaatggggctggaactgctgggacgcaaaatatcaagattatcacaccgcttccgtgcaacaattccaacaagaacagcgcgatttagtccgtttctatatgtggctgcaatttgtggcacaacaacagcttaaagcctgtaacgaactggcaaaacagctcggtatgccgatcggtttctaccgtgatttagccgttggcgtggcagacaacggagcggaaacctgggcggataaagatctgttcgtgttaggtgcatctgtgggcgcaccaccggatattatggcaccgcaagggcaaaactggggcttatcgccaatgcaccctgaagtgttacaagagcgaggctatcagccgtttatcgacctactgcgtgccaatatgaaagattgcggggcgttgcgtatcgaccatattctcggctttgcccgtttatggtgggtgtcgaaaggcgactcggcgaaaaacggcgcttatgtgaaatatccgttggaagatttgctttcaatcttagcccttgaaagccaacgccaccaatgcttaatcatcgcagaagccttaggtactgtgccgaaaggaatgttggaaacccttgaaagcaaaggtattttagcctacaacattttctattttgagtacgaccatcaaggaagcaaaccattggctaactatccgtatcaagcaatgaccaccctaagtactcacgatttaccaacggtacaaggctactggaaaggctatgatttcgaattagggcaaaaatatggcgtttacccgaatgagaaagtgctgaacattttaagaaatgcacgccactcaaataaagaagcgatccgccgagccgttgaagcggtacaaccgctagaagcagatagtgctggcgttacacaaaccttcaaccatcagttacaaagctatgtggcagataccaacagcgtattattcggttcacaaccagaagactggctaaatatgctagagccggtaaatatccctggaacaagcaccgaatatccaaactggcgcagaaaattgagcaaaaccacacaagagatttttgcggatcagacgattgtgcagttgttagaaaagattgaggcgaaacggagaggaatattaaattaaacttagactctattgtttttgaaaaatcataaccttcttatatacttgtcattgcaatagctatataggaaaactagtacaatctgaatgttttcccccagggcaaccgcatatgttgtccatttttcaacctacacgccgagcaacagctcatctcgaaattcatctgaccaaccagcagcggtcaatttccctttcatactctgctttttcgggtgtaatcgtgccaagttcaacgctaatcgacgcaaaattgccagattttccgcaccccattcatcggtcacagcacattcgtcttctttatagaccacatctagcacccaatgggctttgttttccacttcccaatgccctcgcacgcacttcgccaatatttgaatatcaacatccaaactactgatataaaagactttttcttgcgattctttgccattatctgaccgcttgcgacacacctccaacaccgattttatccccttccattcctccgctttgctcagccaatcactcactttcagcttacggtagtaacgctcatcaattcgacgacgttccgcatttacctccttaaacgtctcaaacatttcggggcaatctcggctgattttgtgaaaatacgcctccacttccgactgaaattgacggtgatttttcttcaacggcatcacataatcccctttcttttcgatgattttctccgcaattttcttctgtgtattcatcgcatccaccgttataacggcattttttaagcaaaaactgtcgataatttccatcaccgcctgctgctcattttgcttacccgaggattttttctgcgataaaatcaaaccacgagactggctccacactgtcacactgtgcaaagcactttgggtttccggattgaaactatgacgaagtgtcttgccatcaatcgcaatcacttcacgaccttgttgtgtgcgtatctcattgataaaattaagaaaaacctcattaaacgcttgtggctcaatacgttttattacacgagcgatagtatcatcgacaggaatgccacactcaaaaggacgatattttcgcaaccaatccaaatgtaattcgccaaaaagtttgatttcagtccagctgtttgcccccgaaatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctgtgttttccccctcaattttgcaaatttaatttgccaaatgcagagagttctgttatttatacgcgctttcaaaacaccctaaatagagcggtaaaattagggaagaaaaattccaaaaacaggagtgaaatatgacagtggcaaaacccacttctttaagtttattagcccttgcgggcgtgtcgccttaccaattaggtaaagacgaagagtatatgaatgaagctcaaattgagcatttccgcaaaattttaaaagcgtggcacgcacaaattatggaggaagcggaacgtaccaaaagtcaaatgcaagatgaagtgactaacttcgctgatcctgctgaccgtgcaacgcaagaagaagaatttagccttgaattacgcaaccgtgaccgtgaacgtaaattgcttaaacgtattgagcaaaccttaatcaagttagatgaaggtgactacggttactgcgatacttgtggtattgaaatcggcttaaaacgtttagaagctcgcccaacggcagaactttgcgtagattgcaaaacccttgcagaactacgtgaaaaacagatgggcggttaattaagtagggtgggttttaacccaccacttccgcatataaattgaaacggtgggtcaagacccaccctacaattttatataattgaggtgatctattttaaattacatcaaatctttttttagtcgtaaaaaaaaggatacaaacccaccgcttgttgaaacagatcaagcgaagaaagttgctcgcccaatgcgttcagccccagaattgactgaaccgcaccgacacacaccaaagaaaaaatcaaaccataaacaacaagctgtaccgccccatattctgcataaaaaatttacccaacctgcaggacattacggtatttcgccaaaagattttccaagtaacgccattgccattatcaataaactgcaaaaaaatggctatgaagcctatatggtcggcggttgtattcgggatttattactagggcaaaaagccaaagactttgatattgcgaccaatgctcgcccagaagaaattcaaaaaatctttggtcgccagtgtcgcttaatcggacgacgcttccgcttggctcatattgtctttgggcgtgagatttacgaagtcgctacattccgagctgatcatcacagcaatgcgacggaaaaaatgtcgaaaaccagcgaagcaggaatgctgttgcgagataatgtttatggcacacttcaggaagatgcagagcgtcgtgattttagcgttaatgccttttactatgatgttagccataatttgatctacgattttttcaatggcatagacgatctgaaagcaggaaaactcgccttgatcggcgatcctgttactcgttatcaagaagatcctgtacgaatgttgcgtgcaattcgctttatggcaaaactggatatgttcctagataaagcgagtgatgaacctattcgcaaaatggcagtattactgaaaaatattcctgccgcacgtctatttgatgagtcgttgaaattactgcaatcaggctacggtcacaaaacctacgaattattacgcaaatatggtttatttgaacaacttttccctgtattaagcccattttttaccgaatatggcgacagcaatagcgaaagaatgatcagcaaggcactcaattctactgatgaacgtattcgtgatgatttacgggttaatcctgcctttttatttgcagcactactttggtatccgctacgcgagaaaattgacgaattgaaaaaccaaggtggtttaaacagccacgatgcgatgatgttggctgccaatgaaattttagcagagagtgtcaaagcggtcgcattacatcgtcgttataccacggttattcgcgatatttggtcattacagttccaatttccaaaacgtacgggaaaacgtccacagcaaactctcgaacatattaaattccgtgcaggctttgatttactcgtgatgcgagctgaaattgaaggtggagatttagtcgaattaagtgcgtggtggcacgaataccaatttagcaatgaagcacagcgtgcggaaatgttaaaaacagtcaaacagttacccactttccgtgacgaagaaccaaagaaaaaacgtcgtccacgccgaaaattcaaccgcaaaaagaaagtcgtaaaaggggaagaatagtgacaaccgtgtatgtggctcttggctctaacttagaagatccgcttgctcaacttaagcaagcggttgtttcgttgcaaacctttgcaaaaaatctaaaagtcagctctttttacggcagtaaaccattaggtccacaggatcagcctgattatgtgaatgccgtggtaaaatttgacacggatctcaccgctatcgagctacttgataagttgcaaagcattgagaatgaacaagggcgagttcgtttacgtcgttggggagaacgcaccctcgatcttgatattttgctctatggcaatgaacaaattcaaagcgaacgtctaactgttccccactacgatatgcacaacagagaatttgtgattgtgccgttatatgaaatcagtcctgaattggttttgccgagtgggaaatctttagcacaactttatccgcaatttgcagagcatcagatgaatataatagttttataataccgattattatgtaaaactattaataaaattgataaataggtagcataataagtggcatagtagacaaacatattctgagttttgtacgttagtgagaaactttatttaatttatagttataccaactttttaacacattccccttctcatcacaaaactcaacaaagttttcaccgactttaaatttaaaatcattacttaaatgaagcacatcatctttattctgatcccaaacataagtccctttttctgtaaaaggatattgctctttattcttaaaataaaccgtgttgtattgataggttttatcactatttaaaattaattgtgcttcgattttttcgcaatctgcacaaggtagtgtaccttgataagtgccagaaacacttttttgaggccatagcgaacaggcacttaacattgcgataatactggcaaatgcaatttttttcatagtcatatcctcttaggttaagcagatttaaaattaggatttaccttaaagtctaaggcggttacttcaggaaaatctgcctgaattaagtgtaatagcgcggtttgttgcaacaatagcccctgacgaatagtgccattttgtacttcaaacctaagtaaattatcggataaattcaaaattcggtaaagcccacggtattgttcgggcagtaattgctgaatttttcgatttaattcattgagttcattggctcgttggacaattttcgtcaagctagagttctgcaaaatctcattgatattttttattgttgaatttttcatctttcctgctgtgctttaacttgtttttggtgagattgtccttatattctgcctattctacaaaaattgtcgtataatcaacattatttttttattgagtactaaatgaattttttacgtcgctttcataaacctgcattgatttcgcaattcctgcttggcattgtggcgatctttgctttgccaacggctcagccgttagcgaatgaaagtgaaacattgcctacaaatcaacttgtattacgcttaagtgatttttcttcagttcaaaaagttgagttagaggcagcacacttattacatttagaacaacaacctctcgttattccaactaaacaagcggtcgttttttgcgaattttttgcaaaatcataccgcttgtatcaagtgtcaaatccgccgattagggctggaccaacagcgtaattcttctatcttccttcctctgtttacgggggaaggtgccgaaggcaaaagaggaagctaaagttgcaagttagtcgcaaaatccccccctcagccttcggcagctccccccgcaagcagggggagcgtaaactcgttactaatacttattaccttatatttttttggaaaaaattgatatgtttacaaaattaatgactgctatttttggtagtagcaatgatcgtactttacgccgtttaaacaagcgtgtcgcacaaattaaccgtttagaagctgaatttgaaaaattaaccgatgagcaattacaagcaaaaaccgctgaatttaaacaacgtttagcggaaggggcaactttagatagcttattgcacgaagcctttgccactgtgcgtgaagcgagtaagcgtgtgttaggtatgcgtcattttgatgtacagttaatcggcggtatggtgctgaccgaacgtaacattgcagagatgcgtacgggtgaaggtaaaactttaactgcaaccttaccttgttacttaaatgctttaacgggtaaaggggttcacgttgtgacagtgaatgattacttggctcgtcgtgatgcggaaactaaccgcccgttatttgaatttttaggaatgaccgttgcggtgaatatccctgggctaccgtccgatgttaaacgtcaagcttatttagcggacattacttatgcaacgaacagcgagcttggctttgactatctgcgtgataacttggctcattcgaaagaagagcgcttccaacgtccattacactatgctctagtggacgaagtggactcgattttaattgatgaagcgcgtacaccgttgattatttcaggcccagccgaagatgcgacacaaatttatcaagcgattgataaagtcattccgcatttaattgctcaagataaagaagataccgaagagtacacaggcgacggcgatttcacccttgatctgaaaagcaaacaagcccacttgaccgagcgtggtcaagtgaaagtcgaaaatattttgacggaaatgggcttaatgcacgaaggggaaagcctttatcacccagctcgcattagcttattacaccacgtttatgcagcattacgcgcccacaaactgtttgaagtgaatgttgattatatcgtgaaagatggcgagatcgtgatcattgacgaacatactggtcgtacaatggctggtcgtcgttggtcagatggtttacaccaagcgattgaagccaaagaaggggtgaacattcagggcgaaaaccaaactgttgcctctatcacttatcaaaactatttccgtctgtatgaaaaattagctggtatgacgggaacagcggataccgaagcctttgagttccaacaaatctacggcttagataccgtggtgatcccaactaaccgtccgatgatccgtgacgacaaaaccgatttaatgtttaagagcgaaccagagaaattccaagcggtgattaaggatattcaggattgtatggctcgtaatcagcctgtattagtcggtacgatttcgattgaaaaatcagaagcactgtcagaagcactaaaacaagctggtattccgcataaagtattgaatgccaaattccacgcacaagaagcggaaatcgttgctgatgcaggttacccaggggctgttactattgccacgaatatggctggtcgtggtacggatattgtgcttggtggcaactggaaagctgaaattgcaaaattagaaaacccaacccaagagcaaattaacgagatcaaagccaaatggcaagagcgtcacgacattgtaatgcaagcgggtggtttacacattattggtacagaacgccacgaatctcgccgtatcgacaaccagttgcgtggtcgttcaggtcgtcaaggtgacccaggttcatcacgtttctacctatcattagatgatgcgttaatgcgtatttatctcaacgaaggtaagcttaatatgatgcgtaaagcctttactgaagaaggcgaagtaatggaatcgaaattgctgactaaagtgattgcttcagctcaagcaaaagtagaagcacacaactttgacggacgtaaacagcttctacaatacgatgatgtcgcaaacgaacaacgtaaagcaatttacgagcaacgtaactacttacttgaaacggacgatatttcagtgatgatcaacactgtgcgtgaagatgtgtttaatgcggtcattgaccagtatattccaccacaatcgatcgaagaaatgtgggacgttccggcattagaaaaccgcttgaaacaagagtttggtatggaactgccgattgtaaaatggcttgaagcagaagatgatttacacgaagaaaccttgcgtgaacgtatcatcaacattgctaaagagcagtatcaagcgaaggaagcgatggtgggtgcagaagtaatgcgtagttttgaaaaaggcgtaatgttgcaaaaccttgatgaactttggaaagagcatttatctgcaatggactacttacgcaaagggattcacttacgcggttatgcccaaaaagatccgaagcaagagtataaaaaagagtcctttgcaatgtttaccgatatgctcgaccacttaaaatcaaacgtgatcagcgtattaagccgtatccaagtgcgtagccaagaagaagtagaacaagcagaacgtgaacgacaagctcacgctgaacaagagtcatctcactaccacgcagaaggtgaagagcaggatttcagcaatcttcatatcggacgcaacgagccttgcccttgtggttcaggtaagaaatataagcattgtcacggtagcaaagcgaaatatgcataattagcaagcggtcagataagtaaattattttacagatctgaccgcttggttttatacaaggaattattatgtctaaacctcttattcaagtttcagctggaattatccgcaatgaatttgggcaaatttacttaacacaacgtttagaaggacaagattttgctcagtcgctagaatttcctggcggtaaggtgtcgcaaggtgaaacacctgaggaagcactacgtcgcgaattagaagaagaaatcggtatttatgtgttaagtgctttcccgtatgaacatttcagtttcgagtatccaactaaagtgattgagttttttttctatttggtggaagagtgggtaggtgaaccttttggtcgggaagggcaagagggattttggattgctcaacaagatttagaagaagggcaatttccgcctgcaaataatacattgattaataggctgaaatttgaagccagctactcattagaaaaataataaaaactaacgatatttttctatatgcttaaaaatagcgacaagaaatagtagcattgtcgctattttattgttctatgccatgcaaaatgtcgacctaggacaaaataactttaacatccttacctcagaatcgcagaagctatccgataaacccgatcaaactgttccaacccgtttagacgatgggtaatcatcagcaaggtttttccttgagtatgggataaaatctgttttagtatctgttgctctgtatctcgatctaatccttccgttgcttcatcaagtaagaggatgtcggcagtgctgagtaatagacgtgctaatcctaatcggcgttgttcgccaccagagagtggacgaccgccttcgcctaaccataaatctaaaccttgttcttcgagaaggtagcttaaattgacttttgccagcgcttcagataaagcttcgtctgtggcttgtgggttgccaaagcgtaggttttcacgcagggtattgctgaaaatgtggacgcgttggctaagtacggcaatttgttggcgtaatgttttttcagggtaatctttaatattgcaaccatttaagaggatctcgccgcttgtggcatcgtaattgcgggtgagtagttggaaaattgttgattttccgctacccgttttacctaatatggcaatgcgttcacctttttttatctcaaatgaaatatggttgagtacttgctcgtgctctggtgaataggaaaaacttacctgattaaagctaataagcggttggttagcctcggtttgtttccattgagctgtgccattaaattggactgtcggttgctgtgcggtaatttcactgatccgttctgccgcttcaatcacttgtcctagatgtaagaatgccattccgatcggcattaagatttcaagggaagcaagcacgcaaaagacaactaaggcgataagggcttcggggttgtctgcctgtggtacattaatggcagtcgctgataagtaaatcacggcagtgactaaaatgccgttaataaacattaagagggcatttgacaaaccgcctaactggctttcgtggctttgtgccttgagccattgctgttctgtctgttttagtctgtctgtggcttttgacaatacaccaaatagtaaaaattcgccgttgagttggatccactcgataaactgtgagcggtaggtggctctggattgtatcgcgattttgcctaattttctgcctaaatggtaaaaaagtgtcgggaaaatcagcaataatacaactaaactgccacaaattacccacgctaataaagtcgaaacaaaagataaacctatccccataaacagaataaccataatggcactgataaaaggggaaagtaggtttagatagagtgtatcaagggtatcaacatctgcaacaaggcggttaagcaactcactgtggcgataacgatttaatcctgcagggctaaggggaatgagtttgctaaataccgcaatgcgtaaattagccagtacacgaaaggtggcatcgtgtgtgactaagcgttcaaaataacgagaaatagtacgaccgatagcaagtcctcttacccctgacgatggataaaagaaattaaagagcaggcttgagccaactaaagctgatgctgctaaaaaccaccctgataaactgagcaagccgatactcgcagtcagactggtgatcgccaaaataatacctaatgttaaacgcccaaaatgagttttatacagggcaagaaaagggaaaagtgaacgcatagcttattgatttcctaataattctgcaaaaaaaccttgtaaggcaagctcggtaaagtttccacgttggataatttgcccttgtttcattacccaaatttcatcagcttcttttaaatcttcaatacgatgggtaatcatcaatgtggtttgctctcggctgagattgttcaatgcacttaacacctcttgttccgattgcatatcaaggctagcggtaggttcatcaagtaatagcagttgagatcggcgtaataaggctcgagcaatggcaatacgttgagcctgtccgcccgaaagcccgatgttgctatcttggatttctcgatctaatcccaaacgatagacaaattcatcagcctttgacaaggcaagagcatttgttaaatcggtttcgttggcgtgttcattacctaatagaatattttctcgcagtgagcctcgcattagctgtggattttgtccaacccacgccaaagtcgcacgccattgagccatatcgagttctcttaactcaatgccattaattttcacgctaccttgataagataagaaacccagcaacatattcatcagtgagctttttcctgccccactttgccccactaaggcaatatgttgatgagcctgtagttggaaatttagtggttccgttaatgctttaccttgtggcgagaggatcacacaatcttgagcgtgaatttcaagcggttggtttggcacttttttttgcccggtggtttgagctaaaactgtttcacttaaaaaatgctctaggctatccgccgccccgattgcggctgctttatcgtgataataaacccctaattcacgcaatggttgataaaattcgggggctaacatcaaacaaaaaaagccgataaagagggtaacagaagtatcgtaagcaccaaaattgagttcacctaaataggtaaaaccgaaatagaccgccattaccgcaatagaaatggcggtaaaaaactctaataccgcagaagaaagaaatgccattttcagcacgtccattgtactttggcgaaattcttcggtgcgttggtaaatttgctctgtctgtttgtcggcttgcccaaacaagcggatcgtttctagcccttttaagctatctaaaaactgtccgctcaaacgagagagaataccgatatttctttgatttgcttcagcagctttaataccagctaacgccataaacaatggcaacagaggcaaggtagcaaatagaattaagccagccgcccagttcaacggaaaaacagccgccaaaatagcaagcggtacgatgaaggatagatattgctgtggcaagtagcgagcgtagaaattatggatattttctacttgttctaacattaacgttgcccagcttcctgcagggcgttgttggatcgacattggaccgatttgagacaacttagccattacttgctcacgcaaatgaacacgcaacatttgcccagctttaaaacctgtccgttctcttaaccaaagcaatatcgctctgcctgcaaagcaagccagtaataatccaagttgtgacagaaattctgtcggtgaacgatgctcgacaatcatctgatgtaacattgtggcaagtaaacccatttgtgcgattaataacattgcactgaatgagccgaataagacatttaaataaagccacttttttacaattttttgctgttggcgtagccatttttgtaattgtttttgacgttgtttttccacgagtgtccacttatatgtgcgtaaatgatgaaatttcaattaaattactgagatttttcaaaaccctgataatattcttcaagcaatttaaaattacaacaatattgttcaaagttatcttttttattaattgcttttgaataaactttagttgctttctcctttatttttctttgatttattgggttattgataaaaagcatttctttcatcaacaatgaagcatatttatgctcttcttcaaattctttagtaagatctatgtcttcaataacagtatctaaaacaggaaacatattgtttagtttaatacccgcaatagtttttttattatcgaaacccgttgtgattttaataacaaaacgcttatcaaatggtttcttattatttttagtattgggggctgatgataatggagcaaaataagaaatatggttaattgttaatacaacgccaacaaaaatacgtcttttatttttatccaattctttttcgggagaaatacgagtatcaatagagtgtaaaaattttgtatattcaggattaattctgcacaatttgagttgaagttcttgtttcatattgatattcctttataaacacaaaaaggcacttaccgtgcctttttgttttatatcgcactttaatggtagcgttcaccacatatacatcgcactttaatggtagcgttcaccacatatacatcgcactttaatggtagcgttcaccaaatcaggatattaatcctatcgcctttgatggtataaattttctatataaaagtcaatctttatttggcgtgctaatttccattaaaaactaatcaaattcataccgatacatcaaatctaccgcttgattgatacttgacacccattgcaaatagaggcttggggcaaggcggtagcgtaaggttaattcggtaagaggggcaaaaagtcctacgccatattttactttgaatttcggtgttaaactaccactgacgacgacttttgtgttatcgccaatccctgcggtagtgacattgagatcgttgataccaaaggcactgccgacggtgccaacggttttactgctttttgataaactcattccaattaaggcggcagcaacggaattgcttgaacctgcatcgctaccgccgtctaatcctcgtccagttaaaatgtaggataatgcctgatcctgtgacattgacggggttgagaagattttgacttcgggggcatcagcaattcccgtgactttaacccctgcagttacattggcatcttccattgcttctggattgcggatcgcttcaatgtctagggttggttgggaaggcaatccagtaaaggatataagccctttgcggataacgagatcttgcccaaatgaggcaaaggtgccgttttttaaatggacttgtccatataaacctaatcctcgatttccttgttggactttgataatgccgtttagatctgttttaagaccataggcatctaattttacgtcgttaccaatgttaatagcgacatcagctttgattgccattccgttgttattttgaggcaagttcttgtttagtaaagcggtagctttgttcttgttttttgctgatccgtccataatcacttcgtcgctactgatagtgacagcactttcaggtagttcttctacggcaattcttgcccaaggaatatcaatatttccgccaaggattaactcttttggcgtagcttttacttcaatatgtgggctgagatcaactttggcgatattagaaatatcaacacggaagcggttggcctgtgcttttattcgtgtatgccaagcctctagtttttgccaatttgcatcgccttcaagtaatagttggctttctttcgtttgaatattgccttttaaggttgaacttgcacctttaaagtttaaggcaagcattccacctgttacatcaaatggcattgatttagaatgcacttgtagccctgttaagtttaaattgcctagcagttgtggagatagggctgttccacccagtgttaaacgagcgttaatatccccattaactttttcatctgtgctaagtagcggttcgattaaacgtaaatttagctgatctatattgatgttgccagacagtcctcgctgtttggtaagttctttcatcagtagcttgctggttaaacgcccgttattttctatgcgaatatcgctatccaagctcaaattgttttctgcgattttgccatttaatttcaatgatgaaagggacagagggaaactgcgtccgttcagtttttgtgtaaatttaaggctatttgaaagtagctctacattaacttcgagatctttttggctaaaccaagccacatcgcctttggcattgatgatacccgttaatatactctctttcggcaagtattcttgtagcatttcaaggttaaattgtttgatttcaaacggcactttcccctctttaccagcgctaaatgtttgtggcaagcagagcgttgcttttggatttcgccaacaatgtgcggaaacatctgctttaagttcttgattgtgatagctaacttgtagatttttatcatttttccattcgccaacaggggtatggatattgagattacttagttcaccttgccattgttgtttgctacgatcaaacttccctgctaactgaagctggatacccacaggctttcctttagcggtcagtttcaggctatgatttgcttcactaccatttgctgtaagattagcgttctctagcgttatttcgccgtaagttaattgacgcaagcctatttcgagatcaccttgcacttgttgtgcggttcttactttccctttggcattgagatgttgtagctgaaattgatcataggctacattattagcgataagatcgagatctaaactaggttcattgatatttccctgtagcttaatttgtccgttgatattggcttttaagtgtgggattaaaccttgtaaattcggggctttaatggtggcattgaaatcagatttttcgcccaaaacaccttgcattacaatgcggttttcgccataaattaaacttgcttcagggatattgagtaaggtgttatgatctgcagtcagggtgccttttaactgtaaatgcttttgctgtaagttgccgtgcaaatccacattgtctagtacaaccgcccattcattgcctgtttcacctcgcccaacaaagccttgagaacgaaattcccccgatagtaacgcaacccattcaggaaaaatggatttagtattgacattctgtaaggcaaggttggattgccattctaagccgtttgtccaatcgactttgccactgaatttggtttgcccttgtagtgcgttgagcaatgtttcattgactgcaaaataggttaattccccctgcccttttaggcttaaatctgctgggggaatgttcatacctttggcggataagctaccgtttaagtagtaattgagtagatcgccttttaaagcgaggtcgattttttcaaagacaagcggatctttacctttccctgcgataaaaggatagctgaattttgggcttttaatgctgagatcaagcggtgttttaggctccgaaaattgcacagtgccgtgtatatttgccttgaaagcaccgcttgttttgagatctaattttgcgatgccaaagagttccccagacaaaataagctctgcctgacttgtcgggattgcaagctcttttaaatgtggaatttgggcattgagcttccaatctaaaggataattacctgacaaggtgagtttgccaattcctgaaatggtgcctttgtcgctttgcaggttgagtttttgcaattccaccgattgttcgtcagatttcgcttgtaactcaagcaaactgatttttaatagcgatttttcgcttatacctttagcggtcttaactttctggctcaactgcaattgttttgcttgaaattccggcacagagagattaacaggtaattgaataggatctaatttggttaagatcggttgtgcaagttgttgttttaaggcttcccaatctattggctgagagggtgcgtcagcgactttttgaagcttttccgtggtttgttgcggtgcaagggaaacggttaaaccttgtaattgagttggggataatgaaaggctcttcccttttccttgaatgcccgattggaaatgctgtaagccaatatcaagttcatcaacttgaacctttagattgtctatgcttatctgttttaacgatacgccaattggaagattaaactcaccgcttgtttgtgtatttggagtggacgggggaagtttgctggtatcaaccgccacttgcgtgtctttgattgcaatcttttccacacaggctgaatatgtcaataagcaactgaaatctaaatgtaattccgcttgtccaacttgaacattgaccccgttgagctgatacgcagtatccgtaagcgttaagccattttgtaggcttccctccactttgccaatcgaaagcggatctaaccatttatctgcaagggttaaagcggttctttgccccattcctgttgcaagaaaagctaaaggcaataaaagcaaaatcagtagcacacataaaccacgccataaccaacgccattttgtgttgtggggttttactgctgtatcattgggtgattgtgctaaagattgctctttttccataacattatctcactaaagttctgtgcctaagccaatgtagaattgtagcccttttttattatctggcgatcttactggcattgctaggtcaaatttaactgccccgataggcgaagcccaacgtacaccaattcctgcccctgaatgtagggctttgccactgaattttttatcggataagcccgtatcgtaaaaggtcgctgcccaccaatctgggtacacttggtactgatactcaacagaacctgttgctaaatgcgatccccctgttagtttaccttggttatttttaggggaaatctttttgtaaccaaaacctcttacgctcatatccccccctgcaaaataacgtaaggaaggtggaatacgttcaaattccgctgattttaaatagcctatctctgctcttgcaacgatacgatgattatcaaaataggttcttacccacgccgttgaggctttaaaactgtagaagctcacttctgaaatgaaggctttatccccaaaattgatcgtaaccttttggctatccccccataaaggaaagcgtctgccatcagaacgcgtgcgatttagagaggctgttggatagagcaagaaggtcttaaatttatcactaccctgctcaaaagcatcataacgggttttaaccccgaaggaaaaggcccagcctgtttcgtggttccagaaacgctgaaaagcagaatatgcccctgtaaattgggtatcgttttgattttctcgatcaagcccacctgacacctgatagtagtaatgaagtggctgtgcttttacaggcattttgtaaccaaactccactctctgtttaggcttagataaatagctatttagctctaaactatgtccacgcccgtttatccaaggttttttccagttaaattgcaaacgaggaccgacatctgtggcatagccaatacctacttcaatatcatttttctttttaggtattaataatatgtctaaatccacctcttttgagggctgctttacacttggttcaactaaaacagatgaaaaccagctacttgaagaaaaatcgttcgatagtatcgataaatcgttcaaataataatagtcaccagacttaatacgcaatatattcgtgagatattcctctcgaatttgattgcctttaaaccctattttgccatagcggtaacgtttcccactatcatagcccaatcgccaatcggcaagatattccttcggatggacttctaaacggtgatacaaccactgcccatcaaaatagccgtttgtttgagagagtttttctatactgcttttaaaattgtcgtaggtttcgtgattaagcacggttcccattggcggaacctctttggctaataaccgtttaaaatcatcgtcttgctcggcttgtccggtgatcttgatttcccgttcatctaatttaactggctgatccaattgtacatatagcgttaagagatctttgttagaagaagtacgaggggttagttcaaagcgatattgagtattgtaatatccctttgctcgtaaggctttatcgacagtttcttgtacaagctgttggtaacgttctgagctgtccgcatcatcgttgcttaactgcgagaggtaaatacgcacattttgatagagatctttatctttgatcccatcaacttcaagtaacactgtttgctctgcattcgctataccaattaaaactaataacgaacaaaaagataatcttgttttcatcgtgttattctacttaaattaacataaacctattcctgaggtatccctcttaataacggtactacccgataaggtgctttagaggttaaagcaggttcaatctcaaacaacataataaatggtttaaccggttcgacattttccgttttccataaactactcaaactcgccaactgaatatccgcaggtaaatttgcaatccccagttcaagcacggcgatactgtgcttacgaggatgcccaatcataatcgcaataccgtgtttgcgagcatattgaacggcgtgttgaaattgccgttgtacatcagcaaacacatcactattatctaaaaaaatgtggcgttctaatgcatttaacccataagcttttgctgtttgataagccacactatcccctgcggttttactgtctaaaaaccccaacccttgctgtgataaggctttcatcaagtgctgcattgtcgttttatccgcagtcgctttactacccatatgattattcaaggcaatggcgtaaggcacttgctgttgagcctgatgaattaactcactcacctcgctttcccccattcccactaataatgccccagcttcaataggctgtttcactttgggttgcataggtaaatggattaagatctctcgtccttgttctttcgctttatttgctcggactgtggcataaggtgcagaaggaataatggcaacattgacctctttgggtaaggcataaatggcattatcttcttttattcgatagccaatatcatcaataacgatcaccaatttattcgcataagcaagcggtgcaaaaagcccgaaaatttgcaaaagcaacaaaataatagaccgcttgtttatccatttgttcattttactgtacccatttcaaaggattgaccgccacacctttacggcgaatttcaaaatagagagctgaacgactttgaccgccagagtttccaacgcttgcaatcacctgccctgcttgaactcgctcacctttacgcacattgactgattgattatagccatacaacgacatatcgcctttaccgtgttcaatcacgaccacttccccataaccttgcaaccaagttgctaaaatcactcgtccaccagctattgctcttacaggtgtgcctgcacttgcttgaattaccacaccattccatttaatttcacccatctgtgttgagccaaagcgattgatgattttcccagaaacaggcatacgatatttcccagataagccattacctgcccgaacttgctgtttttcagattccgttgcgctacgacgttcttccgtattctttttctgttcaagtttcgcaatatcttgtttttcttgctgttcagactcattgcttgcttgtaccaactgatttcgcaacgcctcttcattcgctttcagattttctaaatgaccttgatcttgagctaaacttttatcaatagaacgcaatgtactttcacgttcatttttgactttctgaagatctttttcttgcttcttctgtttattaagttgcgtctgttgccctttttgttgctcttttaactcatctcggcgagctttaagatccgcttgtgtgcgacgtaactcatagatcgcatcaatcctcacttgattgatatgctcataataagcccccattcgatctgcatttttggcttcttcggataacaatctctctaagactgaagggtgaatacccgaacgataggcagagtccaattgttccttaagcttctctttttgtaccgcttcctgcttttctaaccgcttgatctcttgttctgtgcgtttaatcgatgcccttgtttcagacaaagtcatttctgtttgttttaaactattaaggactttccccatttcaatttcttgattttttaatgtagattgcaaactatcacgttttttcttttgctcatcaattttgttttttaatgcctgacttttctgctgaattttagacaaatcaccagccatcgtttctgtaaacagcgttggaacagcatacactaaaacaatcagagcaaaatatttaattaatttcaaaagagatccttaattcagattaatataatgactagtggtatatctcaaccgcagatataccacttattctcactacaattttccttccatctgtgatttcactcgagcaacttcctcatctctcaacacacggcgtaaaatcttgccaatgttacttttcggtagctcatcacggaattcaatttcacgaggaattttatagcctgttaaatgctggcgacagtgattacgtaattcctcacgggtcagactttcatcttttttagtcacaaagaccttaatactttcacccgatacttcacttggaataccaaccacaaccacttcattcactttcggatgtaatgccacgacatcttcgatctcattaggatacacattaaaaccagatacaataatcatatcttttttacgatcaacaatgcgtaaattgaggtcttgtcccagctcaacaatatcacctgttgccatccagccatcttttagcacttctgcggtatcttcagggcattgccaataaccttgcattacttgagggccttttacccataactcgccacgctcacctatcggtaaatcattaccagcatcatcaacaatacgaatgtcggtatttggtactggcacaccaatagatcccgaatactccgtagaatcgttacgtgttgccgcaatcaatggggaacattcggtcataccataaccttcaataatgtggcaccccgttgtcttatgccaacgatccgccaccgcacgctgaattgctgcaccaccgcctacagagagcttcaagttagaaaaatcaacttctttcagttgaggattattcagtaacgcattaaacaaagtatttacccctgtaatcgccatcacaggatacttcttcaactctttcacaaaagctggaatatcacgagggttagtaattaacaaccccgttacacctagttcgataaataataaacaattcactgtcaaagcaaaaacgtgatagagcggcagagcaattaccccaattcgctcttggcttcgttggattaaaggataggctacccattttgcttgaagaatattggcaatcacattgctatgacttagcattgcccctttagccactcctgttgttccgcctgtatattgaagaaacgccagatcatttttatagagcgttggtcttacatattgacgctgtttcccgatacttaatgcctcacggaaactgaccgcatgtggcaatttatatttaggcaccaattttttcacatacttcacaacaaagttgaccagcgtacgcttaccaaaagagagctgatcgcccatacgggtcaaaataacgtgcttcacctgcgtattgaacaccactttttctaaggttgccgcaaagtttgacacgacgacaatcgccttagctccactatcattcaattgatgctctaattcacgcggtgtataaagcggattgacattcaccaccactaaccctgcacgcaacgcaccaaacaacgcaatcggatattgcaacaaattcggcatcatcaacgcaatgcgttcacctttctcaaggcgtaattcattttgcaaatatgcagcaaaagcacggctacgctcttccaatttacgaaatgtaagtacctggcccatattaatataagcaggaatatcagggtggcgttgtaccgccttttcaaacatctccaccaacgactcgtaaggctccacatctaaggtacgttcagcctctgctggataattatcaaaccaaattttttccattacatctcctttaaactttacccaaaaatacaggaataaactgagcctgagatttttgagcaatagctcttttaatcataaaaaaagtcactgccgtagtacacaacacaccagcagccacccataattcattgtgaagccattgcgataaaaccaatgttgataacacaatcacaaataatggcaccgcatataaccaaaaaacaccttctaacaaacttctctcggctaacccaattttcactttatcaccgacttgcaaaggcattgcaatcactaaatcaaattgcggtgcaaatttttcccccgccaatgcagaaagggcttttgaaccgcaatggctttgagctacacaaccgccacaactagattttgcttggcattgcactctagcaattccattttgatactgaataacagtggcttgttcaatcatcattgtttttcaccctgcgagctaaattcaatctcttgcacaatatggcgtgccgatgctaatggaatttcacccacaataatcacatctttatccccgattgtctggctataaacactggtttttccctcacgccaaaactgatcttgaaatgaaatccccttattttgtaagagatataccgtaaaagagaacagaccatcactgtataatcgactttcaatctgctcatcttgagccagcacctcagacaaattttgttgccccgaagccacctgcttaaatccacgaggtacccattttagttgccattctaaaggttttagttccgaatgtattttagtttgcaacagcgttggaagaattaatgtacgaatcggttccacaatgtacaataattgatcacctaccacagattgaattgtcctaaattgctctaacacattattatctctatccaacaagtgactctgcaacagcagataattttcctcatcaatccacaacatatattgataacggaaatcatctcttggcacaattcgaataaccctcgcaatacgatctgccacacgcattttcccattatctaaaaatgcatagccatcaagctgagaaaaatcactataaacgaccgtcgggaaatcatctaaaatatggggtgttttcaaactaaacggctgataatcaccaaaataacccaccacattttcccttaaaatcatctcctctcttatcgcatcaagatgaagtaattgagcatactcatgcccattataataagcatgccgataacgtaacgaagttacatcatcacctttttgaaaaagataaagctgctcatagtttaaagtttgatgagcgttattcatcgcagtcaaatagtctaatggcgtagataacggctgtgctatccccattatagagataaacaagctaattaataaggcaatatattttttcataaaacacctacaccatttaaacaagcggtaatattctgcggctttttagcattacatttgcggaaaagtgcgaaatatattaccaaatataatactaaaattgtaatagtatgattattactatgaaccccatgtcccaacattctcaacgcccatattaatgaagattaaaacaacatagattcttgacacatcatatccctgcatcttgcaagcagagttttacggcacagagctgataaaaaatcctcttttacaccaaaagaggattttcctagtacaatgaattatttcttcgtcggacgttgccaaccttgaatatggcgttgtggcacacgggtaataaccagttcatcagccgccacatctttggtgatggttgaaccagccccaatggttgcaccgcttgcgacagtcacaggggcaactaactgagtatcagatccgacaaacacattatcaccaatgatagttttaaatttattagctccatcatagttacaagtaatagtgccagcgccaatattcacatttgcaccaatttcactgtcgccaatataggttaaatgccccacttttgaaccttcgccaatggtagattttttgatttccacaaagttaccaacgtgagcttttgctgccagctctgtacctggacgcaaacgtgcgaatgggccaacatcagcactttcgccgatcacactatcttctaagacagaataaggcttaatctcaacattatcacctagcaccacatttttcagcacactgccagccccaattttaacgttattgcctaactggatagcaccttctaaaatcacattcacatcaataaccacatctttaccgtgcgttaccgtacctcgcaaatcaaaacgagcaggatcaatgatcgtcacgccagccaataacaatttttccgcttgtgctttttggtaataacgctctagtgcagcaagttgcaagcggttatttgccccttcaacttccattaaattttttgcctgaacagcttcaactttataaccatcacggtttgccattgcaatcacatcagtaatgtaatactcgccttgagcattgttattatctaattgcgataaccattttttgaaactagcaccacttgcaaccattacccctgtattaatctcttggatctttaattgctcagggttagcatctttttgttccacaatcgcaactacggaaccattttcacggatgatacgaccgtaacccgttgggttatccaataccactgttaataacgcaatcccattttcaggtttagccgcaatcaatttctctaaagtttctgctgtaatcaaaggcgcatcaccataaagcattaaaatgttttcatcattggcaaaaaatggagcagcctgttgcattgcgtgtcctgtgcctaattgctccgcttgtaaaacccaatttactggctctgcagataagcgttgttgtaataaatcaccgccgtgaccataaattaagtgaatttgttttgccgacagctgttttgctgtatcaatcacgtgttttaccatcggttttcctgcaatcgggtgcaaaacttttggtaaatctgaatacatacgagtgcctttacccgctgctaaaatcacaacgcttagttgagtcatattaactccttaattaaaataactagaggatactgaaaacttttacattactaaaaccattctctttcaaataaagagcttgcaatttgctcatcacaccacgctgacaatagagcagatagattttcgattgatctaagttgccgaaatgattagagagtttatagaacggtagctctttgacttcaactccttcaaggctgaacggtttttcatccacttcttcagggctacgaatatccaaaatcacatcgttttcgcctaattccgaagtggtttcgacagataccacctctttttccgtctgttgagcaatttcacgaatatctaaataatgggcgttttgtaccgcttgttcgagaacgtcaaagttgaaattcccttcttcttcgataattttgctttcaatcgctttaaccgttggattttttgaaatcacgccacaaaattccggcatcgatttggcaatatcatctgtgccaatctcttttgccattgcgatgatttgctctttatcgtgggtaatcagtggccgtaacactaaagtatcggaagccttgtcgatcaaacgtaagttggtcaaggtttggctagatacttgccctaatgcttcgcctgtcacaatcgcttgaatatcaaaacgttcagcaattttgctggcagcacgcaccatcattcgttttaacaccacgcccatctgcccgttatcaactttttctaaaatctcgccgaccacattctcaaagttgatcgccacaaaacgcactttatgggacgagctgtaacggctccaaatatggtacgccatctgtttcacaccgatttcgtgtgccgcaccgccaagattgaagaagcaataatgcacacgagaaccacggcgaattagcatataacttgatacgcctgagtcaaaaccgccagaaatcagcgatagcacatcttcctgcgtaccaatcggataaccgcctaaaccttcgtgacgagctttgattaacaacatcttatcctggtcaatatcaatacgcaccgttacatcaggattagtcaatttcacacttgccgattcgatatgctgatttaagccgccgcccacataacgttccacatcaagcgagcggaaatcgtgcttacctttacggcgaacacgcacgcagaaggttttaccctctaattccccttttactttcgcaagggtatgctcaaaaatgtcatgcattgtggtaaacggcatttcttctacttcaagaatatgatgaataccaggagtgcgtttgagtaaacccagcacgagtggagcttcttcagcgacttttgctcgcacttcaataaaatcccagttgcgaattactgccacattttctgtttcacgcagtaacacattacggatattggaggttaaaattttgataaagcgtttacgcacggaatcgcttttaatcataatttcagggaaaagtttgataataaatttcataacttacaatatttgtacctacttcaaataatacttgcctattaattatttcagcattactacctctacctaatcacacatcacataagatgatcgaggaaagtaatgttatattccatagacataattaagcactataccaaacacttatttgttaattaacgataagaactctttgcgagtatctctgtcttgcaaaaacacaccgccgaatgcagatgtcattgtttggctatgcgtatctttaacaccacgacatttcacacagaaatgggttgctttcacataaaccgccacatcttccgtttctaaaatggtttgaaatgccgttaaaatctgctcggtaaaacgttcttgaacctgtggacgttgcgcaaaaaactgcacaacacggttaatttttgataatccaataacccaatcttttgggtaatacgccacggccactttaccatcaattgttacaaagtgatgttcacaggtgctggttagggtaatatcgtccaccaaaaccatctcgctcactttcatctggtttttgatttttgtgatttttggaaaggtttcataatctaaaccgctaaagatttcgtccatatacattttcgctaaacgatgtggcgtttcttctaaactgtcgtcgcgtaaatccaaacctaataattcaaggacagcacgcatatgttgctggatttcattacgacgagaatctttatctttctgatggcaaaccgttggggtttcaatcccttttgcaagaagtgcatcacgcacactttgggcttctggagagatgttgctcattgatgatcctctaaaaatttaagcgaaagattctaccaaattgccttaaaaatacaacgcaatccacaaaaatcgtgtagaatcattcgcaattacatcaaaaagagaataataaaatatgtattaccattttaatactcaacttgtcgccgatgaaaaacaatcttttgtgcagcaattactagattgcaaagatttcagtcaatccaaccgcttgttaggttcatcaaaagggcgtggtacaacttggtttctcaacaccgaaaaagaactcggtgtaaatagtgtgcttcgtcattattatcgtggtggcttatttggtaagctcgttaaagatcgctatctttttcaaagccatgaaaaaacacgagcaatgcaagaatttcgtttgctcgctcagctctctaaatggcaaattccagtgcctcggccgattgcaattagagtgaagcgtcaatgttgtttctatcaagcggatattttgttagaaaaaattgcagatacccaagatctgagccaatatctacaaacaaagagcttaacaccagcacaatatcagcagattgggcaactgattcgcctgctacacgatcatcaagttcatcactcagatctcaacattcataatattttgatcgacaatcaaggaatattttggctgattgattttgataaatgccaaatccagcaagggaatgaatggaagcaaggcaatttggatcggctattgcgatcttttaataaagagaaaggaagattatctatccatttttacccacaagactgggaaatcctataccagagctatatgaacaactaaaacgctcactttgacgtcccctatacccaaaaggacagggacgtcaacatagttctcccaaataagacttccccttgcaaacgctagacgttttccatacttaaaaccaaaataatattgaaaaattgcgtaaaactcaccgcttgtaaatcacttttatgctactattcccaccaattttattttttaagatgtaactccaatggcaaccaaatcaaaatatcaagataaacaaattgaagcactattaaacgatcttattgtaacccttgaaaaacacaaagccccagtcgatctctcgttaatggctttggggaatatggtaacgaacattttagtcaccaacgtgcaaagcccacagcaacgtgaagtgcttgctgaggcatttagctctgccttaaaaaactcattaaaatcggcgaaataatatgttaaatcaacttcgccaccttcttcctgaaaattctcggcaatatcgagaagagatctcacaacgtattagttggggtcactggtttgcgttatttaatatcgttgtggcgttgctgatttcctctcgctatgcctttaatgccgactggccaaacacccttttcggcaagctctatttttttattagcttatttgggcattttagctttgtcgtctttgcactatatctgctgttgctctttcctctgagctttctgattaaaaataaccgagctttccgtagtatttcagtgatatttgccactgtcggaatgacgatcctattagttgataccgaagtctttaagcgtttttacctccatttgtcaccgcttgtttgggatctattggtcaatcctaacgacgacggcgaactgacacgccaatggcaattgccttttgtgccaatgccactcattttattagcagaaatgctttactctcgttggtgttggaataagctccgtagtttcaatcgtcagaagtggggaaaatatgttgcaatactgtttctaacttgcttcacagctacccatttactctatgcgtgggcggatatgaccctatatcgcccgattaccgcccaaaaagcaaactatccgctttcctacccaatgactgcgcgtagtttccttgaaaaacacggacttatcgaccgtacagtattagaacagcagatcgaagaaagcggtcggttagacaccttttatctcaactacccacgcaaagccttgcaatttgttgaaccacagcataagcctaatgtacttttcattaatctctctggcttaaaaaatgaagcgattaccgcagaaacaatgccatcgctttaccaagtcagccaaaatgctcgccgtttcacccaacattacaacagcagtgatagcctaagcggtagcgtcgttggactattttacggattaagtggacgctatttagacgcaattttgaacgaaaaagccccttcgctactgatcgctcgtttacaacagctaaactaccaatttgggctattttcacacaacggctttgcagaaccgatttaccacagagccttatttgcccatttcaaattacctaaaacaaaaagcaatcttgaagccattgagaaatggaaaaactggatcggcaaacgtagcgacaaagcattttttagctatctagatctacaacttccagcagggatagactatgcccaacaaagcaaaagtttagattggcaattcaatgaaatttggcaaactcttgaacaacaaggcttaacccaaagtactttaattgtgatcacctctgatattgctgaacaagcggtcactagcgacaacagttttgcacaagctcggatccaagtaccaatgcttatctactggcaaggtgataaccgcacctatagcttaccttctagccatttagacatagctccaacactgttaagccagttcttcggggtaacatcgccaattagcgattatgcacaaggtattgatttaacgaaagaaaatagccgaaaatggcttctagcctcaaactataaatggaatgtagcgataatgccaaatggcgagcaatttcatattaaccgtaaaggcgattttgaacattttgatctacaaggcgaaaaacagactagccgtccgccactcgccctgtttttacaacttattcaacaaagtaatctatttattgaaaaataaatcaaagggctaagtatcgtattccaccagacttagccctctacctttatctatgtctttctacccacttgccatcaaggtaatccacaatccatttggttgccttgccgtttttctcagaggtcacatactgacgtttttctttacggctaaagcggataatggcttcattgccttcagggtcttgttgtggtgcgtctgcaaggtattgcagtttttcagacaaacgatcacggtataaggctaattcagccactttcggagcgcgtgtttcacgggatttcgggaagttgtgtgccgacataaatacaccgcttgcgccatctcgtagcacaaaataagcgtccgatttttcgcattttaactcagggaatgccactggttcttctcgtgggggggcgacttcgccatttttgagaattttgcgagtgttgtcacagttggtacagcccatatatttgccgaaacgtccaagttttaagtgcatatccgaaccgcatttgtcacattcgacaatcggaccgtcatagcctttaattttgaaagaaccttcttcgatcacatagccgtcgcagttcgggttatttccgcaaatgtgaattttacgttgtggatcgatcacatagctgtccattgccgtatcacatttcgggcaacgtttgcgtttcattaatgcgttcgtttccgaatcttcgtctaacacattcagcaattccgcttctggaattaagttcatcgtggttttgcaacgctcttttggcgacaaggcatagcctgtacaacctaagaacacgcctgtgcttgcggtgcggatcgccatttggcgttggcaagtcgggcagtgaatatccgttgctactaaattattcggacgcattccaccttcaagttcatcaagctctgcggtagttaatttttctgagaaatcggcaaagaagcggtttaattcgactttccagttgctattgcccgacgcaatttggtcgagagtatcttccatatttgctgtaaaatcgtagttcattaaatcgctaaaggcttcgtttaagcgatctgtcacgatttcacccattttctctgcatagaaacggcggttttctactcgcacatagccacgctcttgaatggttgagataattgccgcataggttgatggacgaccgatcccacgtttttccaactctttcaccaacgccgcttcgctataacgtgctggcggtttggtaaagtgttggctaggttcaacggcgttcagtttcaaggtttcattcaaactaacttctggcaacgcttgatcttccgctgttttgccttgaattggcagtacttttgtccaaccgtcaaaacgtaatacacgccctttggttttgagttcgtaatcccctgccgttaccgttaaactagttgagtcatattccgctggagtcatttggcaagcaaggaattgtcgccaaatcaagtcatataggcgttctgcatctttttccataccgcttagatcttgcattttcaccatcacattagacggacgaatggcttcgtgagcctcttgcgctttctctttgctggcataaaaattcggtttttcaggcaaataacgctcaccaaattgcttttcgatatagctacgagccatcgtcagtgcatcttggctcaagttagttgagtcggtacgcatataggtgatgtagcctgcttcatacagacgctgtgccaacatcattgttttcttcacgctaaaacctaaacgggtacttgccgtttgttgtaaagtggaagtgataaacggcgctttcgctcttgatgaagttggttttttatcaatttcagtgacgataaatgcagaattttgcaaagattttaccgcttgttctgcttctttttggtttttcgctgagaattttttgcctttatgctgtacaagttctaaagcgagatcgccttttttcgcagacgttttggctaaaatatcccaaaactcttcaggctggaacgccttgatttcacgttcacgctcaaccaacaatttcaccgccacagactgcacacgcccagccgataagccacgagccacttttttccagagcaacggcgacaccataaagcccaccacacgatctaagaaacggcgtgtttgttgagcatttactctatccatattgagctgttcaggcttttcaaaggcttgtttgatcgcatttttggtaatttcattgaacaccacacggctaaaacgctcgttctcaccgccaatcacctcgcgcaaatgccacgcaatcgcctccccttctctatccaagtcggtggcgagataaatatgatcagctttcttggcaagggatttcagctctgaaaccactttttctttacctggtaaaatttggtaagttgcattccagtcgtgataaggatccacgcccatacgcttcactaaagcggtacgttctttctctgattttactaaggctttttgttctgccgtcatacctttagtcgaaaccgctttagctttttcggttttttcctctttttctgcaccgcttgttggtaaatcacggatatgtccgacacttgatttcaccacaaagtcactgcctagatatttattaattgttttagctttagctggcgactcgacaattactaatgattttcccattgagaatacctaaattaaataataatataaataatattgaaattatttcttaaaagtaaatattaaaattgaattgcatcaaaatttttgtaacaatagcaagcatttccctaaaagacaatatcaagctaacatctatggataaactcaaggcaataaacctattttgtaaagtcattgaaacccaaagttttacccaagcggcacaacaagagcagatttctcttgcaatggcgagtaaactggttgctcaattagaagaacacctcaacgttcgcttattacaacgtaccacacgccgtatcagtccaacggaagcaggtttacttttttaccaacgctgtcagcccattttaaacgagctcaaagatgctgaagcctgtgtaacgaacattacctcaacactacaagggaagctcacaatgtcgttgccgatggattttggctcccgttttgttgccccacatttacaccgttttaccgaaacctatccacatctgcaacttaatttagaatttagcgaccgacgtgttgatatcgtcgcggaaggatacgacctcgttttgcgcatcgggaagctcgaagacagttctatcgtggcaaaacggatcgcccaagcccaacatttcattgttgcctcccctcgctatttggaaaaatttggtgcgccacaaaccgctttagagttacagcaacatcaatgtctgctctatgaaagccaaacattatggcaatttaatgaaaacggtcataaaattaaatttaaaccacaaagtcaagtttatagtaataatggctatgctcttgtgcaaatggcaaaagctggacacgggatcattaatatccctaaatttttacttaaagatgagcttgcctctggtgaactgataccgattttacctcatcttgaacaagagttatcagatattagtttactctacccaaatcgccgttatctttcccctaaagttaaggtgacgattgaattttttagtcagcttatgcaagaacagaaaatacacctctaacagacttaaccagcaccatcctattaaaaaccacacaaagaatcaaaggctgccatcaatacacttgaaggcagcctttattattaatatttactcagatatttaatatcttaccactgtaatgcaatacctgcaccagcattgtatttgccttgcgaagttgcacctgcagaaactttaagaatcacacgaccattatcagacattcttgagaatccaacagcaactgcattttgtccctcgaaagtaccaataccagcacccaatgtgcttttacctggtaaagtcacttgtggaatattgctcatagccgttgttgcagcaatacccgcacgaagttgacgaccttcgctctctaacttcgcacccaatctataggcaacattatacaactggctaccattaatcgcatcggttgaagtagaagaaatttcccctgttgcaacattttggatacggcgctcatcacctgcagcacctacggaaaccacaccgtttgcggttgcaccagcgaagccatcataaatcatgttacccaccgttacacttgatactgtaccagtcgatcctgctgtagtcgttgaacctctagaaccatcttgtttccagtttttgagagagcctgtttgactaccatcaccagctgtagccgtcgtattgttacctaaataaacggaattctcaaccgtcccttcaggagttgcagacatccaagttaatgcaccattactatcacgcttattattcacattattaccaagaacaaaggtattgcttgatgtaattacattatcattaccgaatgcatagcttccatcaatgcctttatagattggattacctgcactgtcagtaccaatttgaacaccacgaatgatattcgggtcaccaaacgcacctgatttattcgcaattacttggttaccagtaccgatagcaattgagtttttacccgatgcggttgcacctttacctatagctaatgcattatcacctgccgcaacagctttataacctatagctgttgcataagtacctgaagcacttgagtcaatatcgttagatgcttggttaataggctctgctacaccatcatttgtatggaagaacttgataccttgttcgttcatattatgaatcgcagtaatcacagagtttgtaacaaactcagtttgacctttcacgttgtaagtggtaagtgtgtactctttagcttgtacaatctcgttaccatcagcatccaattcaggattgccattcttatcgcgtttaacttcagtaatgactgaaccatctttgtccttagcataggttactgtagaaccatcttttttctgttcaacttggttaccattggttaaagcgtaaacttggcgaccattgactgcatcagtactattcggtgaaatatcaccatcagcaataccactcaatttcacacgaggatcaactttctctttatatttctggagattgccatccttatcataaataggttgtttggtcactgggtcccatttaacaaactcttcctcgactttctctcctgcaccagtaaggttgattgtattcttatcaccagtcattgtcgcagtgcctaaagtcacagaatttaagttcgttaaatccttagcacctgtaggaccttgtggacccactggaccttgctctcctttaggaccttctgggcctgtatcgcctttcggacctgttggacccgcaggaccttgctctcctttaggaccttctgggcctgtatcgcctttcggacctgttgcaccagcaggacctgtcggaccaactggaccctcaggacctgttgcaccagcagggccctgaggacctgctggacccgcaggacctgtctctccttttggaccagtatcccctttcggaccttgctcgcctcgctctcccgctggacctgcttcacctcttagtccttgaatacctggttcacctttaggaccctctggtccttgttctcctcgttcacctctaggacctgtcggaccttgcggaccaactagaccttgatctcctttaggacctgctgggcccgcaggaccagtttcaccttttggtcccggatcacctttatcacccttaggtcctgttagacccgctgtcccttgcggtccttgtggacccattggacctggtgcaccttgtggtcctatttctcctcgctcaccccgaggacctgctggaccctcaggaccaactggaccttgctcacctgcaggacctgcttcacctctttgtccttgttcaccccgaggacctactgggcccgtaggacctgctggacctactggacccggaggacccatcggaccttgcggacccgtatcacctttatcacccttatcacctgctggaccccgctctccccttggacctgttggacctgcttcacctttcggaccagcttcacctctatcgcccttaggaccagctactcctggagcccctgctggacccgcaggaccttgctcacctgcaggacctgtctctcctcttggaccagcatcccctttcggaccttgctcacccttagcaccttgtggacctactggaccaactgcacccgcaggacctgcttcacctctttgtccttgttcaccccgaggacctgctgggcccgcaggaccgcgctcacctgtttctcctcgctcacccttagcacctgcaggacctggttcacccttttcacctctaggacctgctggacctggtgcaccttgtggtcctcttggacccgctagtccttgttctccttgttcacctctaggacctgtttcaccagcagggccccgaggaccaactggacccactgggcccgcaggacctggtgcaccagcaggaccgcgctctcccgcaggacctggatcacccttagcaccttgtggacctgctggacctgttgcacccgcaggacctgctggaccagtttcaccttttagtccctgatcaccctgttcacctttgtcacctttaagacccttttcacctctaggacccattggacctggtgcaccttgtggtcctgttggacccactagtccttgttctcctcgttcacctctaggacctggttcaccccgctctcctctaggaccttctgggcctgcaggaccgcgctcacctgttgcaccagcagggccccgaggacctgttggacccgcaggacctgctggacccgtatcacctttatcacctgctggacccgcaggacctgtctctcctcttggaccctcaggaccgcgctctcccgcaggaccttgctcacccttagcaccttgtggacccactggacccgcaggacctactggacctgctggacctgggggaccagcttcacctcttagtccttgaatacctggttcacctttaggaccttgtggaccctcaggacctcttggtccttgatcaccctgttcacctttgtcacctctaggaccttgtggacccacaggaccgcgctcacctgtttctccgcgctcacctcgctctcccgcaggaccttgcagaccagcatcccctttctgacctggatcacctttaggacccctaggtcctgctggacctgtttgtcctgttgcacccgcaggaccaactggaccctctttcccttgcggtccttgtggacccattggacctggtgctcctggttctcctcgttcacctctaggacctgcttcaccagcagggccccgaggacctgctggacccatcggacctgttgcacccgcaggaccgcgctctcccgcaggacctgcttcaccccgagcccctgctggacccggaggacccatcggacctattggtccctgatcaccctgttcacctttaggacccttttcacctctaggacctgctggacctggtacaccttgtagtccttgttctccttgttctcctcgttcacctctaggacctggttcaccccgctctccccttggacctgctggacccatcgggcctgttgcacccgcaggacctactggacccattggacctggttcaccttgtggtcctcttggaccctctagtcctcgttctcctcgttctcctcgttctcctcgttcacctctagggcccgcagggcctggtgcaccatctctaatagtatcgaatgtattatcagtataaataattttcacaccgccacccactaaggtttgcgtttctttaattaacttaccaagcgtagaaatcttaatatttccgttctctcgttctaatttaatattatctccggcggtaaaggttacagtatcacccattttgataagatatggatcaaaagaagtagcttgaccacccggtccctgatcggtcttcagtatccagcctgcattattatttacagcattgactacagcttgaacagttgcaaatcctgacatcgtccctattgacaatctgccattatttgtagtgccaaacgtacctgatttagtggcattatcaattttttgtttagtttcctcgtttaatctaaccgtaatcgtatcgcctctagcttcggaagtaagaccatctgcgcctgttactttgagcgtaccatcccataaaccaacttttggtgtatctcctgtgttagtattaccatcaatcttcatggtcaaggatttaagctgcgccacgtttactgcatcagttaattttgtacctgccgcaacgttggtgatttggcgtttgattatctcattacccacagaaactgcaccgataagaaagtcatcagaacctttaggatgactgttaggactgttaccaacactttgtgttgatttaaaaccattctcaacagtactgtctgttattatagaatggggttgtttctccccatctatattcccaagcgtgtctgctttcgaaccataacctaacgccacgccaccaccaacaagaacaattgaattgttaccaagtgcggttgctctatttactaggttggtttgtgcccgttcacccacagcaacagagcctgtgccacttgcagtagctagatagcctaaagatgccgaatgactgcccgctacagaactgccaccgacagccacaccatattcgccatttgaagtacttttcgcaccaattgctacaccttctatatgggttgcttgtgagactggaccgactacaactgatccatgtccaactgcctttgattttccaccaattgcaatggcagcatttcctgttgccctggtgctaagatagcgagaaaatccgtctacattctcatatgcagtaccatttaaatcatcgttaccgattgatatggagccaggcccctccgcgatggtatctcccccgatagcaatagattgtgacccacttgctctagcagctgcacctattgcaactgtttgagtatttgtcgcattggcttctttgcctaaggagacagattctactcttgcatttgctccataaccgattgatatggagcgatacccagccgcttgggtacttgtcccgatagcaatagattgtatcgcttctgctacagactcttgacctattacaattgcttcattcgctctagcattggctcctacgcctaaggcgatagatttgtatggtattgcttttgcacgaaaacctatcgcaacagcagtcctaccactagcgtctgagttctcaccaatagtaatagaaccaggcccaacccaactacttcgaccaataccaagagaaccatcgtcacttccttgattccctggagcagaaccatcttcaaaccatgctgctgaacctactggactaaaaaatatacttagtaatactagacttaaaagacttaatttaaatttatcttgctgtttatctaaaaataatgtgaggtgcatagttgagctcttttatacgtgttaagcgggggaatctcaaaaatatgttccccacgccattgtaaaaaaaaaaaaaaaaaaaaaaacaacaggttacataaaacaaagaataaaataacaagcatttttcaacttttatcaataaaagttagaaataataggcggaaatctaataagtgctaaaatcatttagacaatatattgattctgaatggatttttattgatagcagtgtcatcaaggctcaccagcatgcaacaggtgcaagcggtcaaaatccgcaagcgattggcaaaagtgtggcaggtaatagcacaaaaattcatttagcagtagatagttgtggaaatcctattgattttgttctgacgggggggactttgaatttacataaactgacactttttccactcttaaaggataccagtaatgtcatttatctaaggtaagaagctgtgggtaaattaaaaggcgggtgagctgaataatcgactatttttattcgatcactaaaacgctgataatgcagcacatattcagacgttctatcgccaaaaggtttacttaaatcaaaggcaaggataccaatgtggtaatgccatagatgattttctcgcgcatattttactttttgagcaaagtgcggatcgtttttatgcacgttgtcggaagatttattcctgccttcaaggttggtaaagccaaaattttgaatatgccaaataaatttgttaataagcagacgatccgattgaggaaaattcttcagctccttagaaaacaattcacctaatgtaacttccattccatttatagcgacattagccatttatccagctcctctggtgaattacatttaggcacagcaatctctttgctttcaacgtgtgctttcattctttctagatcgtagttaaatgcaggctcttccaccttatcggcaatttgtttttctacgttttgaacgtaagaaattagtgcttgtttttccattcctgattgaattgcttgcacaatacacgccatttgttgatgaaagtaatccgattgaatataaatttgagccatattacctccaatgctgaatagggttgcatttattctaacagaaatttttgttggaagaataaaaaataacggcataacgagaaatcattatgccgttaaatttgtaggggcaaatgacatttgccctaatatcaatagattaaatcgaacgtttaatctcaaccacttcgaatacctcgatttggtcgccgacttttacatcattgtagtttttcacgccgataccacattccataccgttacggacttctgaaacgtcgtctttgaaacgacggagagattctaactcgccttcaaaaattaccacgttatcacgtaatacacggattgggttgttacgtttgacgataccttcagtaaccatacaacctgcaattgcaccaaatttcgggtgacggaagacattacgcacttctgccaagccgatgatttcttgtttaaattcaggttgtaacataccgctcattgctgctttgatttcgtttaatagctcataaatgattgaataataacgtaaatcaatgttttcgctttcgataatgcgacgtgctgaggcatctgcacggacgttaaagccaagtacaatagcgttagacgctgccgctaaggttgcatcggtttccgtaataccacctacgccagagccaaccactttcacttttacttctgccgttgaaagctcgtgtaaagattgaacaatcgcttctacagagccttgtacgtctgctttcacaatcacgttcaattctgcaacatcgccttccgccatattgctaaacatattttcaagtttcgctttttgttggcgagccaatttcacatcacggaatttaccttgacggtataacgccacttcacgcgcttttttctcatcacgcaccactgtcgcttcatcacctgcggctggtacgcctgaaagtcctaatacttccacaggaattgatgggcctgctgattcaatgtctttaccattttcatcacgcattgcacgaacacggccatattcaaagccacaaagtacgatgtcgcctttgtttaacgtacctgattgaacaaggatagttgcaactggaccacgacctttatcgaggtaagattcgataaccacaccgcttgccataccctctttcactgcacttaattctaatacttccgattgaagaagaatggcttcaagtaagtcgtcaatccccattccttttttcgctgaaacaggaacaaattgaacatcaccaccgaatttctcagaaatcacttcgtgttgtaataactcttgttctacacgctctaggtttgcttctggtttatcaattttgtttaccgcaaccacaatcggcgcaccagctgctttcgcgtgttggattgcttcaatggtttgtggcattacgccatcgtcagctgctactacaagaacaacgatatccgttgctttcgcaccacgcgcacgcattgaggtaaatgccgcgtgtcctggtgtatctaagaaggtaatcatcttaccgtcgtcggtttcaacgtgatatgcaccgatatgctgagtaataccgccagcttcacctgctgctactttcgctttacggatataatctaataatgaggttttaccgtggtcaacgtgtcccataatggtcacaactggcgctcgggttactttttctgcgtgtaagtcacgatcttctaagatcgcttcttctaactcattttctttacgcagaataactttgtgtcctatttcctctgcaacaagctgtgcagtttcttggtcaatcacttggttaatggtcaccatttctcccattttcatcattgttttgataatttcggtcgcttttactgccattttgttcgcaagttctgccacagtaatagtttcaccgatcaccacatcacgcgtaactgcttgagctggtttagtgaaggcttgttgtaatgcactgcctttcttcgcgtgtttacccttgcctttggtatctttttggttacggcggtcagattgacgctcatttttactgccgttttcatcatcacgtccgccttttttggttttcgctacaccgcctttgccacgtccacgattgccttcactacgacgctcagaatcacgttctgcttctaacgcatatttagaagtaaagcggtcatcttcatagtcttcaccattttcaatcgcttcttcacgggcaatttctgctaaacgacgagtattttctgctaaacgacgagcattttctgctgcacgttttgcgtccatttccgctttttggcgagccacttcttcttgcttacgacgcaattcagcttcttctttacgttttgcctctttttcaggatcaaccgctttttcttgttttggttgagcttctgcttttggttgcgctggttttggttgtttatttggcattacaggcacttgatgtaccgctttttttgcttcttcggcttttgctgcttctgcttttttagcctcttctttcgctttggcttccgcttcagctttttctttcgctgctttttctgctgcttctttttctgctttcgctttagcttccgcttcttgtttcgctttcagtgcttcttcttgggcttttttagctgcttcagtatctactttgcgagatttacgcacttccacttgcacttcttttgccttaccgcctgcagtcgtaccgctcacggttgttttagtacgacgctgtaaacttaatttcttcggtgcgtctgttttgatttcattttcactcattctttctctccctgtttttagctaaaccagcaaatttgacgtgcagccataattaattctgcgactttttctgcggttaattcttcaatatcagctaaatcatcaacaccttgctctgcaaggtcttcaagagtggtaatctgtttttctgctaatttaaaggcgatatggcgatccataccttcaagatttaacaatttatcttcaatatgtgcctgttttaatgcttcttcttccgctaacgctttagctgtgatcgcatttttagcacgcgcttgaagttcttcaactagatcttcatcttctaagccatcaattgctgtcagttccttaactggtacataagcaatttcttctaatgaggtaaagccttcttcaattaaaagatgagcaaattcttcatcaatttctaaagcgtccataaagagattaatcactttattgtcttctgcttgatgttttttttctaactcatcggttgtcatcacatttaatgtccaacctgttaattgggtggctaaacgtacattttgaccattacgaccgatagcttgtgcaagcgcgtttgcttcaacagcaatatccattgagtgattgtcttcatcaacaacgattgagctaacatcagcaggtgccattgcgttaatcaaaaattgtgctgggttgtcgtcccacaacacgatatctacacgctcaccgccaagttcgttagtaattgcctgtacacgcgcaccacgcataccgacgcaagcacctactggatcgatacgtttatcattgcttttcacggcaattttggcgcgagaacctggatcacgagaagcccctttgatttgaatcacttcttcaccgatttcaggtacttcaagtttgaataactcttgtaacatcactggttttgcacgagtaacgaatagttgaggaccttttgactcaggcttaattgcataaagtacaccacgcactcggtcacctggacggaagttttcacgcggtaacatatcttcacgcataatcaccgcttcagctttagtggtatcgtcctttttacctgcaagctcaagaataatactttcacgacttactttttttacagtaccgataacaattttgccttcttctgaacggaattgttcaatcactttgttacgttccgcttcacgaattttcgtggtgatcacttggcgagcggtttgcattgttatacggtcgaatgcgatagactcaatctcatcttcaacatagtcacctaattgaatgttcgggtcttcaaattgagccgcttctaaggtaatttcacgtgtgtggtagtgcactttttcaaccactaaccaacgacggtaggtggtaaattcaccggttttacgatcaatcacaacacgcacatcgatatcaatgccgttgcccgttttacgatcttcacgttctgcagccgctttctttttcgttgaaatggctaatgctgtttcaagtgcctcaaaaatggcatcttttggtaataatttttcattggataccgcttctgcggctaataaaatctctttactcattggttttgatttccttagaaattaaaaacggggattaaatttgctttttgaatgttgccaaaggcaaaagcctgtaaattaccatcaacttttaaggtaattaaatcaccttcaacactcactaatttaccttgccatttacggcgatctaacattggaatgcgtaaatgaacaacaatttcacgcccaacaaagcgttgatagtgggctaatgtaaataatggacgatctaacccaggggaagatacttctaggttatatttatccgcaatcggatcttccacatcaaaaatcgcactcacttgacggctaacatcgctacaatcatcaatcgtaacaccgccttctttatcaatatataagcgtacagttgaaaaacgacctgcacgttggcactcaacaccgacaagttcaaatcccattgcatcaatgggatcggcgacaagctcttgtaatttttgttctaatgttgccaaggaaacctccatttgacagatataaaaaaaggacttgaaaaagtccctttaacacaacaaagctgactatgtagccacaaaaaagcctcaaactacaacagttgaggcttcaagcggtttgttttatctaacattttacaatttcaaatgcctagatagaacaaaactcatcgtcttaaccaaaacgatgagccttaaaactggttgcgggggccggatttgaaccgacgaccttcgggttatgagcccgacgagctaccaagctgctccaccccgcgtctgatgtggtgcattataggggataaaaaaatccgtgcaactcttttttttagaaattaagaatgaatgctagatttttagtcaaaatatgctttaagcattatctttcaacaaaaacacccctttattttttatttctatataacaatttctttgggattcatcataatcttctgggttaaggttaatcattaatgttttcccttgccaaagtacggtaatttcccaatggtttcccatatagacagcctgcctaatttcacaatattgagctgcagttccatcacttaacaagcggatactttctggtcgtaatccgacaagacaatcctcatcaggtacttgaaaacgtgctgcattttcaagggtaaaagaaaactcaccgatattaatttgattgccttgtcgttttcctgaaaaaatggttgattcccccataaaatgagcaacaaagagagagtttggctgtaaatagagatttttagccgtatctttttgcataatggtaccctgatccatcacaatcacttcatcagacactgcaaaagcttcactttgatcgtgagtaacatagagtgaagtgatattgagccgttgttgtaactcgcggattttttctcgcattgaacggcgtaaattcgcatctaaactacttagaggttcatcaaataagagaactttaggcttgagaattaatgctcttgctaatgccactcgttgttgctgtccgcctgaaatttgatcgacatagcgatcttcaaaccctgtcagatcgactaactctaatgcttcttttactcgctgttttcgctcttctttggatacaccctgcatttttagcccatattccacattttcaccaatcgacatatgtgggaaaagtgcgtaagactgaaatacgatacaaatatctcgctgttgcgttgcgttgtgggtaacatcttcgccgtcaataaaaatttgtcctgctgtggggctttctaaacctgcaactaaacgtaacacagtggttttgccacagccagaaggaccgagtaacgtgaccattgtgccttgtttaattgaaaagtttaagttatctataactctatgtttaccaaaagatttgctgatatttttcaacacgagaaaatcatttttttgttccatttttctctccaaattcatctttttgctttgaacgggctatatgcgtatcgccaacaagccaatcaaataagaaaatcattgccatcataactacaatcaacattgagccataggcaatcgccattccatattccccatcctctactcgatttaaaatatatgaggttgcgacgcgtgtgtctgctgtaactaaaaagatgatcgcactgactgttgtcattgatctaataaaactcgtaactaaggcagaaagtaacgctggttttaaaagcggtaaagcgacaaagcagattgtttttaatgttccagctttcagtgagagcgaggcttcatctaaggctttatctaactgtcttaatccagcaatagccgccctcattcctactggcatattccgcatcaccatagacaaaataataataagccctgttcctgtcaggtaaataggttgatggttaaaagccagaatataggataccccagtcactgttcctggtacggcaaaacaaagtaacgtcagaaattctaagggctttttccctttaaaatcacggcgaacagtaatataagcaatcaacaaaccaaaaatagccgtaatcggtgctgcactagcagcaaaaataaccgtttggattaaagatggccacgctccactattaaacccttgtccaaaaagattgaggtagttattgaatgtcagtgtgtggtctattccccaacttacggtgaagctaccgtaaaaaatactaccgtatagtacaaagttaaacagaacccaaaaacctaaagtgcaaataattgcccatttcataccgcttggtaatgcttgtacatcacctcgataagatttacctgatacagtgatataagatcgattgccaatccagagatattgcaccacaaaaatcgtaagggaaaagagtaacaagatcacacctaaggtgcttgccgaagcataatctaactgtgaaccagcaatatagaaatagatttgagtggcaataacgtcaaaacttccacctaaaactaaaggggtgctaaagtctgcaagcgattggatcaccacaactaaaaacgagttggctaacgctggcttgagtaatggaaaaataatatagaagaaggcttgatagcggttagatcgtaaagtataagcggcttcttcgacagatgggtgaatagattttaatgcaccgtctaaaatcataaaagacattggggtcagtgcgagggtatgggcaatcactatccctgtaaaaccataaagccagttattactaaagccaagataatcgactaaaaaagcagtcacatagcccgaacgtcctaacataagggtgacacctaagccaacaacaaatggcggtgttacaatgggtaagatagagaaaattttaccaataaacgccgtgcgttttgcaatccgtgtggtataaagagcaaaggctaaaccaaacaacgtagataaaatcccaacagttgtcgcaacacttaatgaattaccaatcactcttaatacataaggctgttgtaagatagacaacacttgacttggtacaaattcactgccgtcgtaaaacattgagatgaaaattgccagtgttggatagaccataaagaaaaagatcaacaaaataatgctaatcaatgaggcaataataaatctgtcaccctgcattatttttaattcagcaagggcatttgtcgctaacgcaatcaacgcaacaattaagaaaaagaccgcataacctaagctgatttttgctaaaattgcggaaagaaagataaagagaaacagcccaactgtcccgaataactcacatttacttcgtaatgttgaaggtgttttgttcggatacagataaagcagtaggggaaaaaaccatatccaagtaaggttaatatcattccaccccatagcctgttgaaattcagctgaagttgcttcaaacagtccatattgcaatgcttttactgggaaaaagcaaaagcctaaaaaagcaaaaataacccaagtcaatgaatgacgaaaaaaaaatgtttgcataaccctctataacatctattccacaatcattcatcattctactattaaacaaaatgatagaatagttaaattataattcagcgccaactaaagaataatcaacccgaaaaagcgaatcgttctaaaatagaaccattctagctcaaaaaaaacaatcaagtttccaaataaaaaaatattggctgagaaatagtagaccagctaaaaagataacaaggaatttacccccccaaactcttccgtcaatttttctgtaaacagacgtaattcttccgtcattaacagaaaatccgcatcgaaacgttgggctttgtcttctttcaaaatatcatcgttcttttcacgcacttcatcggcaaatttgacacgggcaagagtggcatcttcgttcaacacaaaagaaaaatgattttcccaatctaacgcaagttttgtgacaaatttgcccgcttgtaaatgttggctgatttcgtcgctttctaaatcttggcgtttacaacggatgacactgtcggtgtcaaaggatttcaactccgcttcttccagaagtgtcagccagcttggtgtatgcccttttgccacccaatttgtcatcacttcgctcggctgtagcgtgaaggaaatcggcacaacaggcagagagccaagggatttgcgtaacaaagcaagggtatcttcggcacgttttgccgagccactatctacataaacgagctgtttatctaagtctaaccaaatcgccgtaaattgatgtttactaaacgcacgaggcaacaacattgccaccacatcatctttgatcgcctgcttttccgttttcttcagcttgcgttgctctttttgttctaaggcttcaatgcggttttccgtttcttttttgataacgtgagctggcaataatttttcttctttatgggaaaccagtaggaactgctgaccctgtgcaaagtgcaacagctcgcttcctgcaagcggtgacgaccagccaaatttttgcatatcgctttgttggcaaggggtgaattttgtttgctgtaattgtgcgtctaattcactactggtgaagcgtaattcactagttaaacggtaaatcattacatttttgaaccaatatgtcataacatctctctttatctaaaattcattatcaatcaataagttactgaaagttcatcattcattactttgattatatcaccataactcaaaatgatagtaaccattttgagcacgaataccacaatcacttattcgtggtatagaagtatagtaggaaactttccaagcccaaattactataaacgtgacaaaacattttcttgcttaaaacaccaaatgtaaattttgtgatctttctctcattttcgaatattttcgattgtttttgtttttaaggggtgtaaacttactttcgaaagcaatcgtagtatgcagtggttgttttgatgtaggagagaaaatgaaaagtagcgtagaaagacgttctgacattttggcattgttgcaaaaaacaggcagtcatcgagttgaagcattgtctcagcatttcggggtttcgacggttactatccgttcagatctcaatgtgttagagcaacaaggctatattacaagatcgcacggttttgcagtattaaattccagattaatggcggaactttctattgcggataaacgtaataattatcccgaactcaaacaacagattggtcatctagctgcctctttactaaaagagggtgaaaaggtgattttggattctggaacgacaacgaaagcaatcgtaagtgctatcggcgatcttaacttgacagtattgacaaatggacttgatgtcgcaatggcattggtttcttgtccaaatgttgaagtaagaatgacggggggagttttacggaaaaatgcgatgtcgttttcgggagtgatggcggataataatttgcaacattatcgctttgataaagtctttttgggtgttgatggttttgacttacaaaaaggggtcacaacctttaatgaacaagaggctcagctaaatcgcttaatgtgcgatgcagcggatcaggtgattgtggtgactgattcaagcaaatttggtcaatatagccattttgttatttgccaagccaatcaaatagatgtgttagtcacggataataaaattcctctaagttatcgagagtatctcgaaaatgtcggggtgcaagtgttaattgcgtagtttcattctctttccttataaataaatccatttatttgtgagggaaatgcaatgatcctcaatattgctaaccaaacattagaaaagcagaacgctttttggacggcaaaggaaattgcccaacagccagcgacttggcgtgaaacggtttctattgtgaaatcgtcacttgttattccatttcttcagcctcttgttgaatatgcaaaacaaggcgaacttcgtgttatttttacgggggcagggacttctgcttttattggtgaggttgttgcaccgatattaagccagcatttaggttgtgctatcgaagcgattgcaagtactgatcttgtatccaatccttatcaatatctttttgcggataaaccaacgcttttagtctcttttgctcgctctggtaatagtcctgaaagtattggggcagtagagcttgtcgatgaaattgtagaggaagcgtatcatttagccataacgaataatgtcaatggggcattatttaaaaaatgtcagcaagatccgaccgcttacccattagcattaccagaatcaacccacgataaaagctttgcaatgacctccagtgccagcaatatgatgttagcggcattagtggcatttttacccgatgaatttgatgatagctgggttgaggaaacggtatcggtgacagaacagttactagaacgggatctgctcgaaatccaacgtttagcccatctgccattaaaacggatcgtctatttaggcagtgggcatttccaagggcttgcccgtgaaacttctttaaaactacttgaactcaccgctggtgaacgtctaggcttctttgagtcgtcaatgggtttccgccacggaccaaaatcccttgttcaagatgaaacgctcatttttatcttcttatctcagcaaccttataccgcacaatatgaccgtgacctgtatcaagagttaatcagagataaaaaagccagagaagtggtgttactaggcgatacaagcggctcgatccaggctgaaattcacaaactagatgacgcagcacggattttcccattcttagtgattgggcaactttactcgttttatagctcgctctatctcggctacaccacggataacccttgtccgacaggcgaggttaatcgtgtggtgcaaggtgtaacgatttatccatattgatatacaggaggcaaaaatggcaattttaaatgtacgaattgatggacgtttaatccacggtcaagtggcaaacttatggacgtcttatctcaatatcactcgcattatggtcgtcgatgaagtcgcggcaaataatgacattgataaagcaggcttacgcttggcttgcccggcaggggtgaatttaagtgttttacctgtggaaaaagcagcagccaacattaacgaagggcgttatgactctcaacgtgtgttgttggtgacaagaaccccacaaacgatcttacagcttgtggaggcaggcgtaaatctgccagaagtaaatgcagggaatatgcctaaaacggatctaacacgtcctatcagaaaaacagtacacgttactgaagatgatgtggaagtgtttagaaaactttctgaaaaaggcgtgaagcttaccgctcagttagtgcctaatgaagaaaaagtcgatttaatgaaacttttatagaggagtaacgattatgatcgaatggtggcaaatacttttgataacgctctatgcgttctatcaaatcctagatgaaatcacgattgtatctagtgctggttcacctgtgtttgcaggctttatcacaggtttaattatgggcgatttgacaactggattgttaatcggtggttcaatgcaattaaccattttaggtgtaggtaccttcggtggtgcatctcgtattgatgcaaactcaggtactgttatcgcaactgcattctctgttgcagctggaatggatccacaattagccttaacaaccttagctgtaccaatcgcagcgttaatggtttataccgatattttagcgagaatgtctaacgtattcttcgctcaccgtatcgacaaaaatatccaagaccacgcgtatagtgcaatcacggtaaactatctctgcggtgcaatcgcttggggtctatctcgtgcattaccaatcttcttagcgttagtgtttggtggtccatttgtggcaagcctagcagaagcaatgcaaacaggcttcttaaaagttatcgcagatggtttaacccttgcaggtggcgtattaccagcgttaggtttcgcaatcttacttcgttacttaccaacaaaacgtcacattgcatacttaatccttgcattctcactcacagcaatcttcattactctcttcggtaacatcaatgctgtaggtgcatcaacaggtgtaagcaactcaatcagcagcgtaccaatgcttgcaatggcagcaatcggatttgcattcgcctacattgtttaccaacgtagcgtagaaggtggctcagccccagttgcaaaacaaaataccacttctgacaaaggagaaattgaagatgacgaactctaatcaacaagtcggaaatccaaaaggctataaattaacagatgcggacttccgccaaatcaatatccgtaacttattcttcaaccaagttggttggaactacgaacgtatgcaaggttcaggttatttatggattatgttgccacagctacgcaaaatgtacggcgacaacacacctgaactacaaaaaatgatggtgatgcacaaccaattcttcaacaccagcccattctttaacaccattgttaaaggtatcgacttggcacttgaagaaaaacaaggggtgaaatcacttgaagccgttgcaggtatcaaatcaggtttaatgggaccatttgccgctatcggtgatgccctattcggctcactcgtcccagcaattatgggggcgattgccgcaacaatggcagtaaacggcaatccgctaggtgtcggcttatgggttgcggtagcgattgcaacaatggtattccgttgggtgcaactcaaaatcgcttatcgtgaaggggtaaacttagtcaccaacctaagtcaccgtttgaacgcactaaccaatgctgcaacagtgcttggggtattcgttgtgggggtaatgtgtgccacgatggtgaatgtcaaagtaccgtttgttgccactatcggtgagaaagtcgtttccgcccaagcgaacttagaccttatcttaccaagattagtccctgcgttagtggtgttcttcatctactggttactcggtagaccgaaaatgaactctaacaaagcgattatgatcatcatcgcactctgtatcttgctctcttgggctggattgttggcgaaagggtaatttgaacgggacacgaagcgtcgtgtccctacccgcgtatcaatacaacgttattgtagcgacgccacgcttggcgtcctaaaacaagcggtcaaatccacccaaaattttacaaataactaagatctaaaacccaatcactctttcctagatttattcggttttatatcttttaagcgaggtgaactatgcctttccaaatcggcgaaaaggatttcctactcaacggaaaaccgttcaaaattctgtcaggtgcagtacattactttcgtatcgtgccagaatactggtacaaaacgctctataacttaaaggcaatggggtgtaacacggtggaaacctatgtgccgtggaacttacatcagccacagcctgatcaatttaacttcagcaagcgggcggatttagtcaaatttttgcaaacagcaaaagatctagggttgtacgttattcttcgcccaacaccttatatctgtgcggaatgggagtttggcggattgcctgcgtggttgctcaatattccaaatatccgcttacgccaaaacgatccgctgtttatcgctgaaatcgaccgctattttcaagaactgcttccacgcattgccccttaccaaattacccaaggcggtaatatcctaatgatgcaaatcgagaacgaatacggctcgttcggcaatgataaaaactacctaagagctattcgggcgttgatgttaattcacggggtgaacgtaccgcttttcacatcagacggtgcgtggcagaacgccttagaagcaggggcgttgatcgaagatgatattttgccgacggggaacttcggctctcgttccaatgaaaatttagatgagttgcaacgttatattgataagcacggtaaatcttacccgttgatgtgtatggaattttgggacggctggtttaaccgttggaaagagcctgtgatccgccgtgatgctcaagatttagcggactgcaccaaagagttactcgaacgggcaagtatcaatttctatatgtttcaaggcggaacgaattttggcttttggaacggctgttccgcacggttagacaccgatttaccgcaagtaaccagctacgactatgattccccagttcacgaatggggcgaaccgtcagagaaattctacctgctacaaaaagtgttagggcagtaccctgatgccagcccgattgtcgatccgattttgccaaatatcaccgcttacccaccgcttgcagtgcaaaatgaagtgtcgctgtttggtaccttagacacaatcagtgaatgctatgaaagcccgttcactcaaacaatggaacagctagggcattactacggttatctgctttatcgagccaaaccgacagcatatagcggtgagatcaagctgagaatttaccaaggcagagatcgcattcagattttcaacgataaacaaaaagttgccacccagtatcaacacgagatcggcaatgaagtgatgttacagacaccaaatggcgagttccaacttgatctattagtggaaaatatgggacgagtgaattacggcggtaagctacttgcaccgacacaacataaaggtatcggtgcaggggctgtgcttgatctgcatttccacacaggctggcaacattatgcgattgattttgaccgcttggaagagattgattttgatggcgaaaaagacagccaaacgccttcgttctatcaatttaagttacacctagaccaagaaccgcaagatacctttattgatacccgtgagttcggcaagggggtaattgtggtaaatggtgagaatttaggacgttactggaatgaaggtccaacttgttatctctatctgcctgcaccgttactgcacaaaggcgagaatgagattatcgtctttgaaacggaaggggtgaagatcgatagcttaacatttagcgataagccgatttataaagagttgaatacgaagaatttataaggacaacacaccccgaatatcgtcaaacttccccctttgaaaaagggggattgagggggatttaaagatctaaacagttaatcgcactatcttaaaatcccccctagcccccctttttcaaaggggggaataaaaaattcaaaactaccaaaaggagcaactatgagcttaattttaatcagtcacggagagtttgcggaaggcttactggatactgccgaaatgattttaggcaaaatcgacaatgctcaaaccgtctgcttatatccacacgaaggcagtgaagatttccaagtgaaatttgagcaagcactggcgaatgccagcggtgagattgttgttttttgcgacattatgggcggcacgccgtgtaatgtggcaatgcgttacttgccgaaattatcagggttatatagcggaatgaatttaccgatggtgattagctatgtgagtgaagaaggcacggacggcttactggaaaatgccaaagaacaaattcacgatgtggctcaacaacttaaaaacttagcgttaggcgatgatgaataggagtagtagtatgtctaaacaagatttaatgaaaaaactttgcaccaaagagggcattattgctgctcttgcgattgaccaacgtggtgcgttacgccgaatgatgggcgatgatattaccgctcagcaggtcagcgaatttaaaactttgatctctcaagaattaaccccctatgcgtcgtcgatcttgcttgatccagaatttggctgggtggcttcagagaaacgtgatgcaaattgcggattaattatggcatacgaaaaaacaggctatgataaaaccgctgtgggtcgtttccctgatttgattgatgatgtgtccgtctatcgcttaaaagaaaaaggggcggaagcggttaaattgttgatctattttgacattgatgaaccacacgaaattaacgatcgcaaagctgcctttgttgaacgtgttgcttcggaatgtaatgcggaacaaattccgttgttcttagaaattttaacctacgatggctcaaacgaagataaagtctataacgccaaagtgaaaccgcgcaaagtgattgaagcgatgaagttctttgcggacaaacgttttggggtagatgtgttgaaagtggaagtgcctgtggtgatgagctatgtggaaggctttactgacggtgaagtgctttacagccaagcagaagcggcggaattctttaaagagcaaagcgaagcaacagatctgccgtttattttcttaagtgcaggcgtttcagccaaactgttccaacaaacccttgaatttgctcaccaagcaggcagtcaatttaacggcgtactgtgcggacgtgccacttgggcaggcggtgcagaagcctataaagccgaaggtgttgaagccgctcgccagtggcttaaaacacagggtaaacagaatatcagtgagttgctcgaagtgttagaacgcacggcaacgccgattaagtaaaaaagtaaattgccccttttgagtatagaaaggggcaatctattttaaacgtgaggtttacattcaggtagtgtaccttcaatttcaaagagtacatcaccatctttaaagaagacatagcccccatttttcatttttgtccagttctcattttttgtgagaggttgggttgtaataatggtgactttatcactttcttccgtatattcacggaaatcaatcattacatcatcatcacgcaatgctgtgccgaatggggctttgcgacagatataatgtaagtttgttgagcaacgtgcgatcatccagtgcccattggaaagaataaaattaaatacgccgtgtttagcgatttcactggcaatatctacaattgcgtcaaaaatctctttttcacttgttttttgtggaaaacgttgttttaggctggcaactatacagcaaaatgcggcttcagagtccgttgagcctataggctgatagtgattattcgggcaaactttgacatcaaccgtgccgttgtgggcgaatacccagttttcaccccaaatttcgcggataaatgggtgggtattttctaaattgacatcgccacaggttgctttacggatatgggcgataacgttaaaggatttaattcgatattgactgacgagatctgccattggtgatgaggcacctgggcgattgtctctaaaaatacgcacacctttgccttcaaaaaaggcaatgccgaagccgtcggtatggtggtcggttaagcctgcacgccgtcgaaatccttcaaacgagaaagtaatatcggtcggcgtattacaattcattcctaataattgacacataatttacttctttatttacttcaaaaaaatataaaaatcccaccgcttgttatcattaacaagcggtgggatttaagcgaaatttgacaaaaaattcaataggaaaattatattttattgatcttaattcgcctcttttttaattaatgagagtaaaaagagtgttcctgcacaaacaaccactgaaggtcctgctggtgtatctttgagggcagagagtaataatccgccactgaccgataatatgcttaatccgatggcgtaaataaccattgtttcaggggttttggcaaagcgtcttgcggttgcagaggggataatcagtagtgaggtgatgattaaagccccgacaaatttcatacttaatgcaatggttaatgcggtgagcaacattaataagaggcgtaggcgtgcgacatttaggccttcaatttgagctaattcagggctgactgtgatggcgagtagctttttccaatacagagccagtagtgtcgcaatgccgataaccccgatgctgataaagagtacgtcgttaaaaccaattgcaagaagatcaccaaataggtaggacattaaatcaacacgaacattgtctaataggctgatggtgataacgcctaaggataaactgcaatgagcgataatgcctaatagggtatcgactgagtgagtagagtgctgttctaaccagacgaggcaaagggcgagtatgacggtcattagaataacagcaatatagggatcgatttgtaggaaaattcctaatgcaaccccaagtaatgcggagtgagagagggtatcaccaaaatatgccatttttcgccagacgacaaaagctccaagcggtgcggtgatgaaggttaaaaatacgcctgctaaccacgcaggaaataaaatctcaaacatattgcctcaattagtgatgtccgttacaacgacatacattgccttgtaagtcgtgatggtgattatggtgatgagaataaaatgccacgtttttcgcaaattgatcgccaaagaagtggataaaacttgggtcacttgaaattttttcaggtgtaccagcacagcagatatggcgattaacgcatagtacttcgtccgtatttgccattacaatgtttaaatcgtgagaaaccattaaaatagcacagtttaaccattcacgagttttatttaatagttgatagagttccgtttgccctgtaatatccaccccttgcattggttcatctaagacaagcagttgtggacggtctaaaattgcacgggcaagcagtactcgttgtaactcaccgccagataatttttgcatactatgcttagcaaggtgagtgattgaaaatagggacaatgcttcatctatcaagggtttagtgctgttaggcttgagagatagaaatttttcaacggtaatgggaatagagtgatccagatgcaatttttgtggcacatagccaatttttagctgtggttggtgaataacctcccctgatgttgctggctgtaatttcagcaatacttttaatagggtagatttaccccccccattaggaccaacgatagttgtgatagaattggggtagatgtttaaatgaatattttcaagggcaacttgtgtaccaaaattcacattaatcgctttcagttgcacaaggggcttcgttaaattgtggatcggcttaatttgcttgatctgcataacattaataaatttaaggatttaaggaattaaaattagcggattttttgctgttttacaagaaagctatgggaattttttgcccattcctttgtctataataagttagcatagaagaaattatttaggatagaattttgcaacacgttatttttgctagagatcggcgtcgtaagaagaatagaactaaggcatttgtgtttttggtgattatattatctatctttattggtatcgctttaaccttaaaaagaccgagttcaaattcttcagaggctcaagaaatcccgattacgttggctactcagtcgttgcctgaagtttcaacaggattatctcatggtgagcctaagtatatcagcattgattttactgcctctgctaaagaggaacaggaacaagtgaatgccgagcctgttgatgaaaatgcaacctcttatgaagatgagttaagtgatgttgatgatgaagtagaaggtcagtctgcggttgtacctgaaagtgaaaaattatcagaagaagcagaaagtgtgttagaagatctgctagatattgcagatcaagcattacgtatccaaaatcagtttagttatatcgtaactcaaggcgatcagctaaaagatgtactagagcagtcaggattaacacatgctacagcaaaagccttagaaaaaacttttccacagttagccgagcttaaagttgggcaacagttctactggattttagacaataacggtgagctggaatatatgaactggcttatctcagaaaaagaagagaaaatttttgagcgtaaagcacaagatcaatttgcagtacaaactattcagaaaaaaggtgtttggcaacaagatgtgattaaaggcaccattgatggtagttttagtgccagcttaaaggcggtaggtttatctcaacgtcaaattaatcagttagctaacggtctgcaatggcaaatttccaccaataaattgaaaaaaggcgataaatttgcaattttagtgaagcgtgagtatatcaatggtaaggttactgatttaggtaatgttgaagctattcatatcatcagtggcaagaaaagttattatgccattcaagctgataatggacgttattataaccgtcacggtgaaacgttaggtaaaggatttgctcgttacccattgccatttacaccaagagtttcatcacattttaatcctcgtcgcttacatccagtaacaagacgagttgctcctcacaaaggtgttgattttgctgtacgaagcggtacgccgattattgcccctgcagatggtgttgttgaacatatcgcttaccaagcaaacggtgctggtcgttatattaaagtccgccatgggggacaatatactacggtatatatgcacttaagccgatcgttagttaaagttgggcaaagtgtgaaaaaaggacagcgtattgcgttgtctggaaatacaggacgttcaacaggtgcacatttgcattatgaatttcatatcaatgggcgaccggttaatccaatgacagtaaaattgcctggtataggatctggtatgccagataaagaacgtaaagcattcttagtgaaagcacggaatattgaaacaaaacttaaactctagaaggatttataatgaaaaaaattctattgaccctaattagccttgcaatcttaggttcggcacaggcgaatgataaaaacttacagcaacaacttgagaaaattggggcaactaatgtgaaattgtcagaatctgccttgccaggttttaaaacagcgatttccgatcaaggtgttgtgcaaattagcaatgatggacgctatgtaatacacgggcagatttttgaattaaaagatggcaaagttactgatattactaatcgtgcattactcgcagaacttaatagtctagcaaaagagatgattgtgtatcctgcgaaaaatgaaaaacacgttgtcactgtgtttatggatattacttgccattattgtcatttattgcactcaaagatcaaagaatataatgatttaggcattactattcgttatttagctttccctcgtggcggtatgaatactgaaactgcaaaacagatggaagcaatttggacagaaaaagatccagtctttgcgttaaacgaagcagagaaaggtaacttaccaaaacaggtaaaaacgccaaatatggtgaaaaaacattatgagcttgggattaaatttggggttacaggtacgccaaatatggtcacaaaagaaggagagttaatcgctggttatgttgagccaaaagagttactcaaaatgttaagtcactaacccttaatttaaactacaagcggataggttttattctgacatcctccccgcctcaagaggcgggaattcctaagtgtaaattttaaacgtatttaaagacctataatttcatcgtttgaatactgataaaaattgaccatgcattagcttcttgaaagctgctcttcccccaatagatttcataattttgtgatctctttcacattttctcttgaaatccccttgacaatcccaatttatggttacgtcaagcgagagtaatctcgaagtcagaacattaataaacagaatttaggggaaactatgaatattgataaatttaccagcaaattccaatctgcaattgccgatgcacaatctttagccgttggcaaagataatccttatattgaaccagcacatttaatgcttgcgttgttaaagcaaaatgatggctcaatcacaccgcttgttaccagtttaaatgtgcaaccgaaccgtttaagcagtgaacttgatggcattatcagccgcttgccgcaggtgcaagggggcaatacccagccgtcgcaacaactttttcgcttgttaaatcaatgcgataaattgtcgcaacagtttggcgatagctttatttcatcagagctatttgtgcttgcggcacttgaagataatggtgatttaggcaagttattgaaaaacttaggtttaaccaaagagaaggtgacagccgctattcaacaaattcgtggaggggagagcgtgaataatcaaaatgcagaagaaacgagacaagcgttacaaaaatataccattgatttaaccgaacgtgctaaagcaggcaaacttgatcctgtgatcgggcgtgatgaagagatccgccgtacagtgcaagtattgcaacgccgtactaaaaataatccagtgcttatcggtgaaccaggtgtggggaaaacggcgattgtcgaaggtttagcacagcgtatcgtcaatggcgaagtgcctgagggtttaaaaaacaaacgtgtgctttccttagatatgggggctttgattgcaggggcaaaataccgtggtgagtttgaagaacgtttgaaagcggtattaaatgaacttgccaaagaagaagggcaagtgatcctgtttattgatgaaattcatacgatggtcggtgcaggtaaaaccgatggagcgatggacgcaggtaacttgttgaaaccgtcccttgctcgtggcgagttgcattgtgtcggggcgacaactttagatgaatatcgtcaatatattgaaaaagatgcagcactggagcgtcgtttccaaaaagtgttggttgatgagccgacggttgaagataccattgcgattttgcgtggtttgaaagaacgttacgaaattcaccaccacgttcaaattacggatcctgcaattgtcgcagctgcaaccctttcgcaccgctatatttccgatcgtcaattgcccgataaagcgattgacttaattgatgaagcagcgtcgagcttgcgtatggaaatcgactctaaaccagagccgttagacaaacttgaacgccgtattattcagttgaaattagagcgtcaagcgttgcaaaaagaagaagacgaagctagccgtcagcgtcttgcaaaattagacgaggatctgaccgctcgtgaacgtgaatatgcggagctggaagaagtatggaaagcagaaaaatccgctctgttaggcacgcaacacattaaaaccgagttggaaaatgcccgaattgaaatggatcaggctcgccgtgagaataactttgagaaaatgtcggagttgcaatacggaaaaatcccagcccttgaaaaacagttacaagaagcggtaaaacgtgaagaagagggcggtgaaaatcatctacttcgcaccaaagtgaccgatgaagaaattgccgaagtgctttctaaagccacgggtatccctgtatccaaaatgatggaaggggaaaaagagaaactattacgaatggaagaggtgctacataaacgggtcatcggtcaaagtgaagccgttgatgcagtggcaaatgcgatccgtcgtagtcgtgcaggcttgtctgatccaaatcgccctatcggttcattcctattcttagggccgacaggcgtagggaaaacagagctttgcaaaacattagccaacttcctatttgacgatcaagatgcgatggtgcggatcgatatgtccgaatttatggaaaaacacagcgtatctcgcttagttggcgcacctccaggatatgtcggctatgaagaaggcggatatttgactgaagcggttcgccgtcgtccatattcggttgtattgctcgatgaagtagaaaaagcacacccagatgtattcaacattttattgcaggtgcttgatgatggtcgtttaactgacggacaaggtcgtacggtggatttccgtaatacggtcgtaattatgacatcaaacttaggttcgcatttaattcaagagaatgcggaaaatatgagttacgatgaaatgaaaactatcgtgatgaatgtggttgggcaacatttccgccctgaatttatcaaccgtattgatgaaactgtggtattccacccattagataaagaaaatatccgtgcgattgctagaattcagcttgaacgtctaattaaacgtatggcggagcgtggctatgaagtgacggtgaccgatgcggcagttgatcatatcggcgaagcaggctttgatccactctttggggcaagaccgcttaaacgtgcaattcagcaagagcttgaaaacaccttggcacagcaaattctctctggcaaattgttgccgaatagtcctgtgacagtggattatcaagaaggaagggttgtggcagttcagtaaaagagtaagagcgtagagatacgccctttgttttgtgaaatacattgacttttctatgatttctcgctaatttgtgggcgtttttaacacaaaaactatttatttacaggagattctatgcaagatcgtttagtcacttccacaagaagtgaatcccttcttagcacacataaagtattacgtaatacttatttcttacttgcgttaacgcttgtattttcggcagtggttgcatctgtcacaatgacacttaatttaccacgtttaccttggtggggaatgttagtcggtttttatggcttacttttcttaaccaatgcaacggcaaatagtgcagcagggttagcaagtgtttttgcgttaacgggtttcttaggttatagcttgggtccaattttaaatgcttatatcagcaatggcttaggcgatgtggttgcattggctttaggggcgactgcgttggtattctttagctgttctgcttatgtattaactactaaacgtgatatgtctttcttatcgggtatgatgattgcgttgttcgtggtgttattagtgggtattgtggcaaatatcttcttagcaatgcccgcgttaagtttagcgatcagtgcattatttgtagtgttctcaacggctgcaattttatattcaactagcaacattatccacggcggtgaaacaaactatatccgtgcaaccgttgatttatatgtgtctatctacaacctatttgtgagcttattacagcttttaggagtatttagtagtgatgactaaataaatttagctcattggattcattaaaaatagttataaggggacgctaatttagtcccctttattatcaatgtgcctcatcccaattgcttccaactccaacttccgcaatcaatggtactttaagctcaattgctttttccatttcggctttaatcagttgggtgtaatgctctactctgtcggctttgacttcaaagactaattcatcgtgtacttgcataatcattgcaatatcttcgcagtttcgcaccgcttgatcgatcccgatcattgccactttgataatatctgccgctgttccttgcattggggcgttgatggcaacacgttctgccgctttgcgtcgcatttggttgcttgagttgatttcaggcaaatataaacggcgaccaaatagggtttcaacatagcctttttcagcggctttttcacgaatgtctaacataaactgttgcacggctggataacgctggaagtaaagttccatatattttttcgcatcggtacgagaaatgccaagttgatttgccaagccaaattcagacattccgtaaatcaagccgaagttaatcgccttggcactacgacgctgttcactggtcaccgcttccaacggcacgccaaaaatttccgccgccgtagaacggtgaatatctttaccttcggcaaaggctttgatcatatttgcatcattagcaagatgagccattatgcgtaactcaatttgcgaatagtccgccgccaaaatcacatagccatcacgggcaataaaggcttgacggatacgtctgccctgctcgttgcggatcggaatattttgtaaattcggatcgcttgatgaaagtcgccctgttgccgtgaccgcttgatgatatgaagtatgcacacgccctgtttgtgcgttaatcatctgcggtagtttatcggtataggtcgatttcagcttgctcaagccacgatgttccatcaacagcacaggcacttggtgtcccatttgagccagttcttccaacacttcttcgttggttgatggcgcacctttcggggttttcttcaaaatcggcaagccgagcttgttaaataagatctcttgcagttgtttggtagaagcaaggttaaacacttctcctgcttcttggtgtacaagggtttcaagctcttttaaacgctgttcaatctctaccgaatgtgccaacagtttggcaggatcgattaatacgccgtttcgttccacacgggaaagtacgctcaccaacggcatttcgatttgctcaaacagtttcaccaattcaggcgttttttgtagttcagaccataagagttgatgtaatttcattgtaatttcggcatcttcccctgcatattctgttgctttatccagttcaatttgatcgaatgtaagctgatgtttgcccttgcctgccaactcttcaaaaggaatagtttgatgtcccaaataacgctctgccaaattgtccatattgtgacgaccagtgctgtctagggtgtaagattgcaacattgtatcaaaggcaaccccttgtagctcaatgccgttgcgagcaaaaatcgttaaatcgtatttgatattctgcccgattttgcggatatttgggttctctaaaatcggttttaactgtaccaaacagtccgctttgttcaactggttaggcagtaacgcttcgacttcatcgagttctgcttcactttcaccaaacagatccacttgggtcggctgtgtaattttgcctttgtgtgccaacggaatatagcacgcttcgccattttccaagccaaatgaaatcccgactaaatttgcttgcattgcatctaaattatccgtttctgtatccaccgccacaagctctgccatttgcaattttgccagccatttggtaaacagctcagggctgttcacgcaatcgtaagcggtgcgatctatcgaaatttttacaaaaggtgcagatttttgttctgaactgaccgcttgtgtggcttgataattgttcgggattttctctgccgacgtttgtgtcacagggttagcatcattcatcacttcgttcagccagcgtttaaattcataacgaccaaacagctctaccagttgatctcgctgttggggttgagtaataagctgatcgtaagtgacatcaagggcaacatcggttttgatccttgctaatagataagagagatcggctgtttctttttctgcttccagtttcggtgcaaaggtttttgccccacgaaatgataactctgcaactttgtctaagtttgcataaatcgcttgcattgagccaatgccttgcaataacgcaatcgccgttttctcacccacaccttttaccccggggatattatcggacgagtcgcccaataaagctaaatagtcgataatcaactcaggcggaataccatatttttcaatcacgccttcacgatctaacagcgtattgttcatcgtattaatcagcataatatgatcgttcaccagttgagccatatctttatcgcccgtactgattaaaacgtgcttacctgcttgtgaagcctgcaccgcaagcgtgccaatcacatcatcagcttccaccccttcaatcgacaacagcggaatacccaatgccttaattattgcgtgtaacggttggatctgcgaacgaagctcatcgggcatcggcggacggtgggacttatactgttcaaacagctcatcacggaaggttttccctttcgcatcaaacacgacggcaatatggcttggctcaacctgtgcaatcaggctttttaacatattcagcaccccatacatcgcccctgttggctcaccttgtttgttagttaaagggggaaatgcgtggaatgcacgatataaataggacgaaccgtccactaaaacgagcggattttgtgcgattgttgccatttgaactctctttgatctaaataatttgggctattatagcgaaagtagtgggattaaagaaaaggttttgagaaattatgtctatccatatttttccccaaaacgcccccatacaataggggactttacgatttacatcaaaccattacgattctattaacatcggtaattctgacatactcactaatttataatcagccaaagcccagcgagggtcgtcccattccgattttgcaggaataacaacggttttcatactcgccgctttacctgaaatcatacctaaaaccgaatcttctacggcaaaacaggcagatgttggaacgccaagttgttttgctgcgtgtaaatatacagcggggtgtggcttgttgtactccaattcctcagcagaagctaaataatcaaaatattcagctatgccacagctatcaacaatgccttgtagcatatttcttggcgaagccgaagcaactgcgattttaatcccccgttgttttaaggtagataaaacctctttcacatttggcattaatggcttcgcttcaagcacctttccaactacatatgccatcaactcttctattaactgagtacgactcttttctttttcaccatatttttgtagcacataatcaaccagcgtaccaacaggcgaccctgtaagagtcaccatttcagctaaggttacaggaaattgatttttctgaaaaattcagtacttgcttgataccaaataggttgggaatcaattaacgtaccgtccatatcaaaaattacagcttcgctcattttacattcttccgttattaattattacaagtgcttcccctaaaacaaagcaatcactgtatcctacatgcttttcacctttgaaatataattggcaattcattcctattcagataaatagatagaaactaagttatatccccaatttttccttataatgcaaacggcatacagaaagatagctgtcgtttccaccgatttgaatttgatctccatcttttaccgcttcacctttctcattcatacgaataacaaagcctgctttacgcccacaataacagatggttttgagttcttcgagctgatcagcccaagcgagtagatagcgacttccctcaaataattcagactggaaatcggtgcgtaagccgtaacaaagcacagggatttttaatttatcgaccacttcagtcagttgataaacctgctgcctggtaagaaattgtgcttcatcaataagaatacagtgcaatttttcatcggcaatataagcagcgatttcatcaaataaattgctatcgtttttgaataaacgagcatcttgtgaaataccaattcgagaggagactttccctacgccataacgatcatctatcgccgcagtataaacaagggtgttcattcctcgttcttgatagttataagatgattgaagtaaagttgtggatttccctgcattcatcgcagagtaataaaaatagagtttcgccataataaatgatgcaataaaaaacggctaatcaaaatattagccgtttattcaaaaaagattaaacgttgtcgatttgacctaacagagagcgtaaacgatcttggaagttttgatgttcggtttttaattgctcgtgttcttgacgtagagtttcgcttgaacgatttgcttcctcgtttttaccttttaactcttcaacttctaattgaagtaattgaatggtttcaacagcctgtttaattttttcttcaagttggtctaaaattgcgactgacataatatgttcctctagtgagtaataatgaaagtgtaaagattttaccttacttagaagaaattttcattataaagttcggagttatagataaaaaagcacactgttagacataaactttttgtaactttctcaattaggggtagtatatgtctatcaaaaattagatattagattagtggtaaagtagcttgtagggtgggtcttgacccaccatataatcgtaacatattgattttattgatggattaaaacctaccctacaatatttaacctattaatatatggtttgttagcggtctagtacctagtacggagatgagatgaaatgaaaattgagaagaaaagtaatgaggcaattattgagccaattgaagataattggaattggttagatgaattgggagagccagatcctacgtttaattatcaacatatcaaagaatttaaacctgtaccattattaaactacgaagattggttagctgaagataaaaaaatcccctaacaagttgtcaggggattgagggattattttacacgagaaacatattcgcctgaacgggtatccacacggatcacttcgccgatttgaacgaaaagtggaacacgaacaactgcacctgtgcttaatgtcgcaggtttaccaccagtaccagcagtatcaccttttaagcctggatcggtttcgataacttctaattcaacgaagtttggtggagtaacgccgattgcagagccgttccataatgtaatgatacattctgcttgatcaaccaaccatttgtcgttgtcgcccaatgcttttgcatctacagaaatttgctcgaacgtttctgggtgcataaagtaccagaaatcttcatctttataagagtaagtgtagttgtaatctacaacgtctgctgcttcaacggttgagcctgatttgaagttgatctctaatactttaccagatattaatttacggattttagtacgggtaaatgcttgacctttacctggttttacgaattcgttttcaacgataacgcaaggttcaccatcttggataaattttaaacctggtttgaaatcattagtgctgtaactagccattgtgatcctcagaatttagataaaaagtaacgcccaaagggctaagatataaaaaggcatatataatacactaaaaatggcaggcaaaaaattaaaatttttcttaagtatggcggataaagccgtttcaggtataattcaccttttcaatcaatgaggaaataaaatgaaaaaagcagtgttaatgggcttagttcttgcccttagcgtttcaaccgttcaggcgaaaaaagcaggtagaatgaaattttcttcaagcaaaaaaacacccgcaacggttcagcaatctacaacacaacaaaaagctgatgcggactttaataatacgccaaatcaagcaatgccaaatgctggtgctgctcaacaggcgcagggcaaccggttaggcaattttgtgacaggggcggcggcaggttacttattaagtgaagcactttccccaacggaagcacaggctcaaacaccagcgaccaatccaacagaacaattaaccaaacaggtacaacaagtgccagcggtgccgacctttaaagcgattgatccacaaaacgacccttaccttattgaaaaaacaccaggttatttgcgttattgcttaaacggtgtgcaatatatggtgggaaccaataacagccaattaccaccaacattgatggtagataaaaccaacgcaccagtgcagtgtgtgattagccagtaaatcaacaaaaaatgaaattatgtagcactgagtagggacacactgagtgtgtccgcaagatattaattaaatcaaaaatattggtaacggacacgctcagcgtgtccctactgaatatggaaagtttgtgtatttgctacataacatcaataaaaacaaaaggggtaaatttgaacatctcattttacgacgcaccaacaaaagcacaatggctacaagatctggctgaagcctttaatcgaccagaagatttattgcattaccttgagctagacattgcagatttcgagcaagatcttaccgctcgtaaactgtttgcgttaagagtgccacgcccctttgctgaaaaaatgaaaaagggggatcgggcagatcccctttttttacaagcgatcacattacaagaagaatttaccaatgttgatggctttgtccaagacccactggaagaacagcattcgcctgcccctaacattttgcataaatatcataaccgcttgttatttatggtaaaaaatagctgtgcgattaactgtcgctactgtttccgccgctactttccctatgatgaagtcaaaagtggcaaagcaacgtggcagaaaagcctcgactatataaaagcgcattccgaagtggaagaagtgatcttatcagggggcgatcccttgatggcaaaagaccacgaaattgactggattttcacccaactagagcagatttcccatatcaacatcgtacgtattcacagccgtttacctgtggtcattcccaaccgtattacagacgaattgtgtgaaaggctatcacaaagccgtttgaaggtcgtgttagtgacgcatatcaatcacgccaacgaaatagacgaaatctttgcagaaaaaatgcagaagctaaaacaaagcaatgtcgtgttgctcaaccaatctgtcttgctcaaagggatcaacgacaacgcccaaacactcaaagtcttgagtgataaattatttcgctatggcattttaccctattatttgcacctattagacaaagtggcaggggcgagccatttttatattgaagatagcagagcctttgaaatttatcgtgaattgcaacgcattacatcgggttacttagtgccgaaattagcacgagaaatggcgaaagagccgaataagacattgatgggtatctctgcttaattgatattcagttccttaatcgctcaatctctttactaaattcttctacatcatcaaaacttaaataaactgacgcaaatcgaatataagcgactttatctaaggactttaattcacctaacaccaagtctccgacaaatttactagcaacttccctttcccctgtggcttgaagttgtaacacaatgcagtggatcgcttgctcaacatcatcggtactcacgggacgcttttctaatgcacgagataaactggttcttaatttacgttcatcaaaaggttctcggctaccattatttttaacaatatgcggaatgagtaattcagcactttcaaaggttgtaaaacgttctttacagacagggcattctcgtctgcgacgaatttggtagccatctgcggttaaacgtgaatctacaactttggtatcatcagtagcacaaaacggacaacgcattattttaacccttcttgtcttgctacaaattcagcgtataaattttcagggggtggaggcatttgcaaatagaacccttcattttggattttttgcaaaacttcttgattatctacccgcttgagctgcttttcacctgctaaattaaacagcattacaaactcaggtttaccaaaaatttggcgaagttctagaggtacggcctcaaatttatcccgtttttccacataaagatacattccttcttttttggggcttttataaattgcacataacatcttattcgtcctctagtctgtagctaccttcgtaattggtgaaacgtgaatattgtccttggaaacctaacggcactcgtccgattggaccattacgctgtttaccaatgatgatctccgccattccttttgtatctggattatcgtgataaacctcatcacgataaataaacataattaagtctgcatcttgttcaatcgatcccgattcgcgcaaatccgagtttacagggcgtttatctgaacgttgttctaaactacggttgagctgagaaagtgccactaccggtacttgtaactctttagctaaggctttcagtgagcgagaaatttccgcaatttcaagggttcggttatccgcaaatccaggagcgcgcattaattgtagatagtccaccataattaaacttaatccaccgttttccttgtacacacgtctcgcgcgtgaacgtaattccgttggggttaaacctgaactatcatcaatataaatattacctctggattgcaacactcccactgtactaccaaccctagacatttcctcatcatctagttgccctgtacgaatacgcgtttgatcgaccgttgaaagcgaagcaaacatacgcatcataatttgatccgcaggcatctcaagactaaaaattaatacaggcttattcggttgcttaactttattgccgttctcatcttcgacctcaacatcacccattgctgcattttcacacaaattcatcgcaaatgttgttttccccattgatggacgggctgctacaataattaaatctgaaggctgaagccctgccgtttttcgatctaaggcagcaaagcccgttgatatacctgttacaccgctgttattttgagaacgagaaagtaattctatgcgagctaaagtttccattaaaatatcatcaatttttttcggtccttcgtcagttgcagttcgcatctctgcgatatggaaaaccgttctttccgcttcatctaagacttctttaaccgtcaatcccttaggattgtagctgatttctgcaattttattacccgcagcaatcaattcacgacgaatagcccgttcactaacaatctctgcataagctaaaatattcgccgcacttggggtatttttagatagttccgcaagataggcaaaaccgcctatatcttgcaatatgcctttatttttaagcacttgatcaagtgtgataatatcaataggctgattgttacgagataatgaagccatttcttcaaaaatcagacgatgagcgtgattgtaaaaatcggtactctgaacacgctcagcaacgccgtcccagtactcattactcagcattatcccgcctaataccgcttgctctgcttcaattgagtgaggggcaatgtttatctgttcaatctgtttatctttttgaggatctttatttttttgatattcagccattgatgaaactcttttcagggaaatgataaaaaggtagtttaccgaatttgccaaaaattttcagccggtttagcccgtacaaaaatagcgagacacaaaatttgttaataatctgcttcaactacactaatttcattatttaatagtaatcatagaaccaaagttaaagcactgaaaccacagatctacttgtgaaaaacctgcttcttttaggcgtgctttatgtgtatcaatactatctgtccgcatcacattctcaagggctgtacgcttttggcttacttcaagctcactatagccatttgcacgtttaaacgtgtggtgcaaatcaataagaagttcatttattgtgttatcttcaaaagtaaatttttccgataacaccaacacaccatttggatttaacccatgataaattttacgtaaaagagcaagcctgtcttctcttggcaaaaattgcaacgtgaaatttaggacaaccattgatgcatttttaatctcaatatgacgaatatcatcacataaaatttccacaggaatatccgaatgataggcttccaaatgacgacggcagcgttctaccataggttcagaattatccacaccaataattcttactccagctttttccacattacgccgaatcgataaaatcccagccccacgagaacaacctaaatcatagacatttgactgatcagtcacaaaacgagaagcaagcataccaatcgctgtaatgatattagaataacccggcacagaacgttgaatcatatctggaaaaacctccgcaacagattcatcaaaagtgaaatcccctaatttctcaataggggctgaaaatagagcatctttagacataaacaatattattgataataaatggtgtattctactcgcaatttataaagattgtagaaaataatttatttagcaacattcctaatttagtgaatacgtataagtacgatataaaaatgcgcaaatcaggataaataacatcacaataatttgaattaatctctttttagtcaatttctctgccgccattttcactccaaatctaaataaatcttgttcattattccctaaaaaaatgttaaaatttgccttaaatcaaattttaggatggtttcgtatgaaaattgtatctgattttaaagcaaatggaagaacagcctgcacaattcactgtcaaaattgcagtattagtcaattatgtttaccttttactctcaatgaacatgaattaactcaattagataatatcattgaacgtaagaaacctgtgcaaaaatcacaaatcatctttcagtcaggtgatgaactcaagtctatctacgcaatccgttcaggcacaattaaaagctataccatcagtgaaaatggtgaagagcaaatcaccgctttccatttaccgggcgatttagttggctttgatgcgattatggatatgaaacatatcggttttgctcaggctcttgaaacgtcaatgatctgcgaaattccttttgatattttagatgatttagctggcaaaatgccaaaaatccgccatcagattatgcgtttgatgagtcatgaaatcaaaagcgatcaagagatgattttgttgctttctaaaatgagtgcggaagaaaaacttgcggcgtttatttacaatctttcacagcgttatgccgcacgcggtttttcagcaagagaatttcgcttaacaatgacccgtggtgatattggaaattacttaggtttaaccattgaaactatcagtcgcttgcttggtcgactccagaaaaatggcatcataacggtacaaggtaaatatattaccattaatcatatggatgaattaagtgaaatggctggtgttacaaaacctaaactgtcccattgcaatccaaacttataattctttacatactacttatcttgacgttccccccgtaccttacggacagggttgaaaaaaatactcttctatcttaaaaagataatttatgccctagtctccgatctatgagaatgaataccagggctcatctccaatgaaaatatcccttccttctataaagaagatcaattcgataatttgatattaaagagccatttatctaccaaacgcttcccttcctcgcttgatccaaaacgagcataatctacatcaaccaatttcacgccgtccaatttaggtgattgtggagcaacttctgctttcacattggttggtgtttgataaagtccgtggtcacgccaaggaatttcttgaacctctttagatagaacccaatccataaataatttcgcattatcaaggtttctcgcacctttaataatacttgcagcccctaaagcataacctaccccatctttaggtaacacataatcaactggcgcacctttctctttttctgaagcatagccatgagcaaagccaactgtcacagcactttccccacgagaaaggttcgaggtcactaaggtgcttttcacatattgagaaatgttaccatctaattttttcaaatactcaaaggctttttcctcgcccattaattgaataagcgtaatcatcgtggtatacattgtccctgaactgcgaggatcggctaattgcacttcaccttttaagcgaggatcaagcaaatctgcccattttttcggagcttcaacgcctaactgttttaatttttcggtattaataccaaaaccaagcaccatcaaatacgcaatcgaggtatatttacctgcttcgctctcttgcaatgctttaaattgaggtaaaacctccgcttgcaaaggtgaacgataggcttctaatagccccatctgccctgcttggaaatgtggctcaatagtaccgccataccaaatatccgcttgtggattatctttttccgctttcagcttacctaaaattgtccctgttccaccgtgaataaactgagtttccacattatatttttgtgaaaaacgtttcgtcagatcttcacatactttattttggacgccacagtaaactgtcagctttccttcagcctgagcattattagctacaaagaccaatggtgaaagtagtaaaaggcttgaaaaccatttttttaattgcaattttttcatttgtttcacattcctgatgtttaaaagagtcataagtgtaacatttatcctacataaagcaagaacaagcggtttgattttatgctaaaatgacataacactaccctattatattgatatgaaaaaatgttgcttaatcaaattcaaataatcctagtcgaaacctctcacagtggtaatatcggctcagccgcacgagcaatgaaaacgatgggactaagccagctaaggattgtcaccccaaaacaagcgattgacgaacaagcaatagcccttgctgcaggggcaaaagatgtattggataatgtgcaaatttatccagatttcgacagtgcaatcgcagattgccagcttgttattggcacaagtgccagattacgccacctacaaagctcactggtcgaaccacgtcaatgtggcaaattagccattcaacgtgctgaacagggtaaagtagcgattgtatttggacgagaacgggtgggcttaaccaatgaagaactattaaaatgccattatcacttaaacttcccaaccaaccccgactatggctcgttaaatcttgcaatggcggtacaactcgcctgctatgaactccgaatggcttggctagatttacaagaaaaaaccgatattcaaccgcttgcagaatacccgacatcagaagccttagaacatttctttgcccataccgaacgtttatataaagaacttggctttattcgcaacgaagcagttatgctgaaactacgccgtttatatcaacgagccgaattggaaaccaatgaattgaatttattaagaggaatgctgactgcagtagaaaagtactcgctaaagcagaaaaatgactaataataaagggataagaaattacatctcttatcccttaaatcatagctaattaactatagtacctaactatctagattaccataatacacgtaaaccaacaccaagtgctttgtcagtaactttgttgttatcactgtctttgttcttgattaaacgaccttcaacaaaggtaacaacttgtttatgtaatttatagtctgcacctaacatgaattgatgagcagttgctttgaaatcttcaactttgtaagtaccataagagtagtttccatacacgccagattttggagtaacatcaaatcttgcgccagttcttacgaagttaattttctctttaacatcatctgtttttacaacaccatgaccaccatcaacagctacagtaaatggagcgttgacatatttaagaccaaagtacacaccatctttgtctttcttattaaatggtttttctgtataggtatggtctgtagatttaccacctgcttcaacaaatttaccttttagtttaacagatccagatttgtagtcatcatgagtataacctgctgccacagttacagattgactttctgcaatcttagctgtgtatttagcacctaaaccaaagccagatttaatagaatctacttttacatctgccttctcacgctcatttgcaacattatagttagcacctaacgtcaaaccttcaatacctgtataggtatagttaattgctgaatcagaagattgagtaaggatatcaaaaccttcttgaggtgctgaatatttaaatgtaccctgttgattgttcacagtgatagacttatctaccttatatgtatatttaattccaccagtaccaacaccgtatactttatcaaaaccagcttgaccaatgctatcaccgattacagcttgtttaccaaaagaaatttcatgaccatagccacctaaaccaacgtaagcctcatctgttgtaacatcaccccattttgcagcatttttagaaccactgccaaggcgagtctcataacgaccaaaaccgtagagattctcattgatattatgtttgatagaaataccgaaacgagaactattattctttaagttagtgtgaccaccatctgttgaagattgacctttcacttttgaggcttgtttttctaaaagaagacgcaattgaccatcaaaatcaacttttgtaccttcattttcataaactgttacagctgatgctgatgctgcaaatgccgctactgctaacgctactagtgtttttttcataatgttcaccttaagtttttagtttaactaagattactcttattaagctataagagcaaccgatccatatctgccattaccttcccatgtaagtttggtaaatgcagattgcatgcgaatgattgcaaatttgtagagtagtgtcaatatcttacataaaaaaacattttctttaaaatcaataagttaataaatctccactcccaaataagtattcagagataattttttaaaatattgctcctattgcaataaatcacataactatatgatttaaaaataaaaaactcatagcaaataaagatttatgaccttttttctaaaaatgtgagtttcatcacatttttagaaaaaatagaaagattatttttatcaaaaataaatttgaaaagagatgcacatacattaaaatatctatacatttaatacagagaataaaaaatgggtaattttacagatacaatcattacaaaattaaacgacttttctcccatcttgtctctgcaaatctctatctatagccactgctttaaacttactcatggctccgtcaaagaattcatacaagaaatactagaaacatgttcacatattgagcagtcaacttcccctgaaataactgaagtttatactcaacgtttaattgaacaatatgatgctctacaaaaaagtattcatctcaaggataaaaagtcagattcccctattttctctcaatataaatttactaagagtattcatacattatcaaagaaacagaagttacatgaatactataaagcgttgcgtgcattgaatgaaaaactctcatggctcattgaacaaaattaccattaccctgagtataggcatatgctctcaataaagatacaagaaacagagaatagaaaacaaaaatgtttaaaggcgattgaagaattgagctttaatcaggaataacgggagaagattgacgatatattgttgctaatcttatcaatctctagtagtgtctaaatatgctatgctctaaacatacacatcatactaaaaagagtccatagaaaatatcctctcttaatagagaggatatataaaattgtaatactaacgttttgagtattgtggacgacgacgtgctttgtgtaaacccacttttttacgttcaacacgacgagcatcacgggtaacaaagcccgcagcgcgtaacgctggacgtaaagtttcgtcgtattcgatcaatgcacgagtaataccgtgacggattgcacctgcttgaccagaaataccaccacctttaacagtgatgtataagtctaatttatctgttaattcaactaattctaatggctgacgaacgatcatacgagctgtttcgcgaccgaagtacacttccaaagaacgttggttaatggtgatattaccattgcccggtctgataaatacacgagctgaagagcttttgcggcgacctgtgccgtagttttgatttgctgctgtcatttttatgctccgtgattagatatctaaaacttgtggttgttgtgctgcgtggttgtgttcgttacctgcatacacttttaatttacggaacattgcacgacctaatggaccttttggcaacatacctttaaccgcaatttcaatcactgcttctggacgacgagcaatcatttctttgaaggttgcatctttaatgccacctacatagccagtgtgccagtagtagattttatcagtttcttttttgcctgttaccgctactttttccgcattgataacgatgatgtaatcgcctgtatcaacgtgtggagtgtactcagccttgtgtttaccacgaagacgatgtgctaattcagtagctaaacgacctaaagttttacctgtcgcatctactacataccagtcacgtttaactgtttctggttttgctacaaaagttttcattaattaaataccaaaatttaaagtttaaacccaatatcctaatggatattacctattaatacggtagaatctgaccccttcgagtcctattcagaccagacttacatggcgggaataccatgcaaaaacagggtggcaaaattatacagatttatttactaaagatctaattcttttttaagaaagagtggtttttgcggtatatttcaaaattccaacaaatttttataggttttacttctcatcaaattgagaaaatgataaaaaacagctacatcaagctaactaactgtaaaggagtgaactatggaacaatggtctggtaacgtatggactgcaattattgcagcatttatcataggttgtatcatcagttatgttgttgttcgtgcgacaaatagcaatgtgaaaaaacaactacaactagaggctgatttaaaagatactgctaagaaaatggacgagcaaaaacagcaattagaacaacactttgaacaatctgcagctctacttgcaacacttgctgaagactacaaaaaactttatacgcatttagcacaagggtctgaaaaattattgcctgctgaatcggcaaaaattgaatttttccaacaacctaaaattgaaaataaacctaaatctgaagatgaccaacctaaagattattcagaaggctcctctggtttactaaaatcctagtattcatatattattgaatttaagaggagggaatcccctcttaaattctctttaactacatttttcttagaacatattgtctttattatcagaaaatttgatcgaaaacattatattaaatttaatttcagattagaatttgaaaaatttttttaacttatcattaacaggaaaatacaatgtcttgtttatttattgcaggcacagatacaaatgtaggaaaaactatcgttacaagggctctattacaaacaatatctaaatatgaaattcccattgtcggttataagcctattgcgtgtggtggcgatgattctttacccacagaacccaatcaagatgattatgcctgtgaagacaatagtgatgtcctcattatacagaacagctgcccttgtcctgtaaaatacagagaaattaatagctattcttttatccattctagtacgccagtatttgcagcgctagacgcagtacgtcatatttctgttaataaactggatcacgatcttcaacgtttacaccgacaatatgcaaatgttcttgttgaaggcacttatggctggttaacacctattaataaagacctaagttttgctgattgggttaagaaaaatagaatgccagtcgtacttgttgtgggaataaaagagggttgcgctaaccatgcacttttaacagcggatgcgattcaacaaagtggggttaatcttatcggatggattgcaaatcgagtaaatcctgggctacgtcactacgctgaattaattgaactccttagcaaaaaaatcaatgctccattactaggacaaattccttatattggttatcctagtaaaaaagaactatctgagtatattcagaacccagagcctctattaagttttttccataaataatctaattgctggctcttgaagagctaagctcatactgaaatattaaactggctctttattgataataatagactaacaatcatgactacaaaggttgctatataattttagcaaccactctgatttctatgctattttagctagttaaataattcataaatgctgtaattacacctaagttaaccacatccacaaagaatgcacctacaagcggtatgattaagaatgctttatgtgatggtccaaaagtttctgtgacagattgcatgttcgcgaccgcagttgcagttgcgcctaagccaaaaccgctgtgacctgctgcaagaatggctgaatcgtaattacttcccatcactctaaaggtcacaaaatatgcataaagtaccataactatggtttgagcaataaggataattaacattgagccagcaaggtctgctaattcccaaagtttaatgctcattaatgcaattgctaagaataagcttaatgatgcgttaccaaatacgtcaatagcacggtcaaacatatcaaatttaaacactaacgttaatacgtttcttaatactacaccaaaacctaatgcccatacgaattgaggtaaacctgaatcagggaatactttaaccataactgatgagaatgctagacacgctgcaaataatgccattgtttcgatcgttgatgttgctgtgattaagcgtacattgtcagcatcttcaaatgtatcatcagcatattttgcttctacgctttcaacttttacactgtgtttagatggggtaattttcattttgttgataagacggcgtgctaatgggccaccgactaaaccaccagctactaaaccaaatgtagcagatgccattgccatttccattgcacctgcaagcccatgtttctctgcaaaaacagttgcccaagttgcacctgtgccgtgtccgccagttaaagtaatagaacctgtaattaaaccaacaagtggatcaataccaagtagcatagctaaaccaacgcctacaccattttgaacaaggataaatatactcacgataacgaggaaaatgacaagtgggattccaccttgtttcaaacgggaaaaatctgcggataagccgatagatgagaagaaggctaacatgaaagctgtacgtaaagagctttcaaattcaaaggtaattccagcgaatttatatagacaaaaaatgataccagcgataaataaaccaccggcaacagcctctgggatattaaagtcttggaagaacttaattttatttacaaatactttgccgagaagcaaaacaagcgttgcggcgataagtgtgtgataaccgtttaaaacgattggctccatatcattactcctaatatatgatttatgaaggggcggataatattataaagatttagcattgtcaaaatggctatttgattatttagtcgcataaaaatattgttatggtagacatttctctattattttttgagttagatctcattttttgcttggggattttggtagaatcgtcgcagttttatttttttatgatgaggcttttatgagcgaaattgcattaacagtaagcctattatccttagttgctgtcattgggctatggatagggcatattaaggtgaggggcgtaagccttggtattggcggtgtgttatttggtgggatactggtttcccattttatgacgcaatatggtgtcaaacttgatggtcataccttgcactttattcaagagtttggtttgattctctttgtctataccattggtattcaagttggtcctggtttctttgcttcattacgccaatcgggattaaagcttaatgcttttgctgtgatgattgttgggataagcggtattttagtgattttattacacaaaatatttgatgttcctcttcctgtgatattgggtattttctctggtgcggtaaccaatacaccatcattaggtgctgggcagcaaattctgacagaattaggcggtgagtccattactgctgtgatgggtatggggtacgcaattgcctatcctttcgggattatcgggattctattagcaatgtggcttatccgtattatttttaaaattaatgtggataaagaagctgatgagtttgattctgcaaccaacaataaaaaagatggattaagtacgatgaatgttcgtattacaaatccaaatttgaatgggttgatgcttcaagagcttcctgattttgaattgcacgaagtggtttattctcgtattaagcgtaatgatgagttgtttgtgcctaaagtgcatactcaaatccaaataggcgatattctgcatcttgtgggaacaaaagctgcgttgcataaaatgcagctcattcttggtgaagaagtgaatgtttcactttcgacaaaaggcacaatgtaccgcacagaacgtgctgttgttaccaatgaaaaagtatttgggaaacaaattcgccaattgatgttaaaagggaaatatgatgtagtgatttctcgcttaaaccgtgcgggggttgagttggttcctaacgggcaaatgacattgcaatttggtgacgtgttgaacttggttggccgccaagaagatattgaggctgtgatggcgattatcggtaacgctcaacaaaaattacaacaagtacaaatgttgcctatcttcatcggggttggtttaggggtgttactaggctctattccaatttatctgccaggtttccctgttgcattaaaactgggattagcaggcggacctttggtggttgcattaattttagcaagaataggaagtatcaaaaaactctattggtttatgccaccaagtgcaaacttagcattaagagaaattggtatcgtgcttttccttgcagttgtaggttggaaagcaggcggaaacttcttgaataccttattaagtaatgatggtttagcgtggattggttatggtgcgatcattacttttattccattaattgttacagggctggttgctcgtatttatggtaaattaaattatctgagcctatgtggattgcttgcaggttcaatgacggatccacccgctttggcatttgcaaatggtattaaagaaggcaatggtgcagcagcactctcttatgcgacggtatatccattagtgatgttctgtcgaattatcttgcctcaaattctcgctatattattgtgggtagctggctaatcgtaactaagcaatctagttattgacagttcaatagactagattgctcaatttcaataaaacgcaataagtttccaacaatatttaggatccattcacgccatttttataggattataatttattttctatgataaataataggatgtcttaatcacggatttaacgttataatgagaaataaatctgttttttaatggaaatactactttatgtatcgcttaaccttttttttgatatctactttgctgtttaatcccttcctctctgccaaatggctaaagatcaatgatgtagactatatctggggaccatttaaaatctataatatttcattattctctgaaactggcagttatactaatagcacacgcccattaatgctgactctaaaatatcaaaagcccgttgaagggcgtgattttgcaatttctttagctagatcttggtctaatttaggcatcactctgcaaaatcaagataatgtggttgatcgtttgcgtaaaattttacctaatatcaagaaagatgattctctcagttacattgctttagaagataaaggatatttcatattaaataatattgttattcctgaagaatttaacaaagaatttaatgacgctgtagtagcaatatggctagatcctcgtgtagaaattgggcgtaaacttgtcaataaagaagaaaaaaccttcattgcaaacatccctagagttttagagacacaaaaaccacaaaatatagaaaataatataggagtacatgaagaatcaatagatcctgtggtggactcaagcaaagtatctaatgatatcaaacagaacttagactcttcaataatgcctagagtacaagataagcctttaactcagtcaaatgaagagaatatgaaagaagcagaaaaaccacttgaagattcagaaattgatatttctcctcctttagatcccataccagaaggcaaatatctaaatatatagctgattattaaagtgtttatagcattcataataaatcgacaatgccgattcagaactggaaactggcgatgaatcgatttatgattgattttggtgatcgcctagacgatcaccgttaagttgaaatgggtgtttacacagaatttgggatagggttaagcgctaatacttcaccgtatgcccatagctttcaataatacctttaatatgctctaacgattctttcgtcggtggcatcacatcttccaattcatattctaaccctaaggttttccatttatgtgcgcctaaacggtgatatggcagaagttcgactttttctatgttgtccataccttgaataaactgacccaataaatgaatatcttcatcggcatccgtataacctggtacaaccacatagcggatccaagtacgttgattacgtttatgcaaataacgagcgaagtctaaggtacgtttattagagacaccgataaaatctttatgaatttcttcgttcagctgttttaaatcaagcataacgagatcggttacatctagcatttcatcgactagctctgaataattccgcacaaaaccatttgtatctaaacaagtatcaataccctcagctttacaagcacggaaccaatcacgcacaaattccatttgtaacacggcttcgccacctgatgctgttacgcccccgcccgttgctctcataaaatgtttatacgtcacaacttccttcattagattttctacggagatctctttcccaccttcaagatcccaagtgtcacggttgtggcaatatttacaacgcattaaacagccttgtaaaaacaaaataaaacgaatcccaggcccatctactgtgccacacgattcgtaagagtgataacgtgctaaaacagtcattctttttcctttaaataaagtacgattaggacaaatgtccttaaacatttctgctaatcgcaattaatgcgtaagatacaataagcggtcagtttctgcaaaagttttgcaaaatctgaccgcttattagtttaaactaaattacatcgactgagtgaaagtacgagtaattacgtccatttgttgctctttagttaaagagttgaaacgcactgcgtagcctgaaacacggattgttaattgtggatacttctctgggttttccatcgcatctaataacatttcacggttcattacgtttacgtttaagtgctgaccaccttcgatggttgattcgtggtggaagtaaccgtccattaagcctgcaaggttacgtttttgagattcaagatctttacctaacgcatttggtacgattgagaaggtataagaaataccatctttcgcgtaagcaaatggtaatttcgcaacagaagttaatgaagctaccgcacctttttggtcacgtccgtgcattgggtttgcacctggtccgaatggcgcacctgaacaacgaccgtctggggtgttacctgttttcttaccgtaaaccacgtttgaagtaatggttaatactgactgtgttggagttgcattacggtatgttttgagcttctgaattttcttcataaagcgttcaactaaatcaactgcaatgtcatctacacggttatcgttgttaccgaattgtgggtattcaccttcaatttcaaagtcaagtgctacgtttttcgctacgccaaccacttctcctgctttatttttgatttcgatgtcgccacggattggttttactttcgcatatttgattgcagagagtgagtctgctgcaacagaaagacctgcgataccacaagccattgtgcggaatacatcacgatcgtgcaacgccattaatgctgcttcataagcatatttgtcgtgcataaagtgaatgatgtttaacgcagtcacatattgtttcgctaaccagtccataaagctgtctaaacgggtcattacatcatcgaaatctaagtattcagacataattggctcagttttcggtccaacttggtcacctgatttctcatcaacaccaccgttgattgcgtatagtaaggttttcgctaagtttgcacgagcaccgaagaactgcatcattttgcctacgatcatcgggcttacacagcacgcaatcgcatagtcatcgttttggaaatctggacgcattaagtcgtcgttttcgtactgaacagatgaagtttcgatagacactttcgctgcatagcgtttgaaaccatctggtaaactttcagaccaaaggattgttaagtttggctctggtgatggccccattgtgtaaagggtgtgtaatagacggaagctgtttttggttactaatgtacgaccatctaagcccatacctgcgaaagtttctgttgcccacattgggtcgcctgagaataattgatcgtactctggggtgcgtaagaaacgaaccatacggagtttcattactaagtgatccattaattcttgagcttctttttcagtgattttgcctgcttttaggtcacgttcaatataaatatctaagaaggttgacacacgaccgaaagacattgctgcaccgttttgtgatttcactgctgcaaggtaagcaaagtaaacccattgtaccgcttcttgtgcgttagttgctgggtttgaaatgtcaaagccataagatgcagccatttctttcattttgcctaaagcacggtgttgttctgcgatttcttcgcgtaattggattgtcgcttgaatatcttcgccacgctctaacttctcttgtaaagaggtaaactgttttactttatctttcattaagaagtcagcaccgtaaagagccatacgacgatagtcaccgataatacgaccacgaccgtaagcatcaggaagacctgtaattacgcctgatttacggcaacgtaaaatgtctggagtataaacatcgaatacaccttggttgtgggttttacgatattcagtaaagattttctctacttctggatttaattcacggcgataaactttacaagagcctttcaccatattgataccgccaaacggcataattgcacgttttaatggtgcatctgtttgaagacctacgattttctctaaatctttgttgatataacctggtgcgtgtgaagtgatagttgatggaatatcgcaatcaatgtcatacggttcgtgggttttgttttccactttgattttttccatcacttctgcccaaagcgttgtagttgcttcggttgcatctgctaagaaagattcatcaccttcatacggcgtatagtttttttggataaagtcacgcacgtttacatcagtttgccattcacctggtgcaaaaccttcccacgctttcttttgagcttcggttagttgagtcattttaagtcctcgttagttaatgtaataaattggaacgcaagcggtgcgattttgcaaaaacactgcgaaaagtgaccgcttacaagttttgaattaatgtttttttagatgcaaaaaccactgcaccataccgatgaaaaatgcaccaccaacaatgttacctaaggtcgctggaattaaatttttcaccacaaaatttgccattgttaaatcagcgaattgactaggatcaacccctatcgctgtccaaaattcagggcttgcagagccgtgaattaacacgcccattgggatcataaacatattcgccacacagtgttcaaatccagatgccacaaacatggctatcggcaaaatcataatgaacgctttatccgtcaggctcttacctgcatacgccatccataccgcaatacagaccatcagattacagaaaatccccaagctgaatgcttcaatccaagtatgatggatcttatgttggactgtttttaaaatagtcaagccccactgcccatttgcagccataatttcaccgctaaaccacactaacagcacaataaaggtcgcaccgatgaaattaccgccatacacaacaaaccagtttttaaacatctgcgcccatgtaattcgcttacttgctttggcaacaatcgtcatggttgttgaagtaaaaagctctgctccaaataccacgcacataataatgcctaaagagaaaacaagaccgccaatgagtttagcgacaccccatggcatatccgcagccccaacttgggtagttgcataaaagacaaaagcaatagaaatgtaagcgccagcagtaattgctgaaatgaaagaataaaattggtttttggttgctttataaactgcgccatcttcggcgatttttgccatctcagcaggtgaaaacattactatccttaaacgaaaatttgaaaaattatagaaattgttgagaattatagacctgttaacctgatgattaaataatttttacgtttaaaataaataaagtagaattctttcttgatccatatcaatctttcaaaaaaagtacaatttttgaaaacttaacttaaacacaaatttaacaaaatagttacaaaatgaccgattatttgactgctttactcggaattttccttagcgaagagaatcaacttctcattatgtttgtcagcagctttttaagcgcaacaatactaccaggcaattccgaagtgatttttaccacttatacaacgcaagcactattacaaaaaaatacggtgtatggattattcgttgtagcgacattaggaaactccctcggtagtatgacaacttattttatcgctcaattttttccacaacctaaatttcatgaccaacaacataaaagcatcaagctcacgcttaaattgagccaaaaatatggtatatggattctattatttagctggcttcctattgttggcgatatcttttgtggtattgcaggttggttacgattcaacttatggaaaagcatattattaattactctaggcaaaggaattcgttatgcattgctactttggagcgtttatttggttgctggttaaggactaacagtctacaatatgaataaattatttttgatgagaaaagctatgtcaaaacacccccctgaaatcaaatctatctcagtaattgccaaaactcgcatttttgaagtgcaatccgtcgatttacgtttttccaacggcgaagaacgcacctatgaacgtttaacgccacaacgtcgttcatctgtcatggtattacccattcataataatcaactgattcttgttaaagagtatgctgtcggccctgaacgctatgaactcaccttccctaaaggcattgtggatagtggggaagatcctgtactgagtgcaaatcgagaattacaagaagaaataggttttggagcaaaaacaatcgaaccactgcgttcagtgtatagcggtcctagccatatgtacggcttaatgcaccttttcgtggctcaagatctctatccatcacagctagaaggcgatgaaccagagccacttgaaatcatctattatccattaaacaaaatcgacgaactgcttgccgaccctaattttgccgaagcacgcaacttatccgccttatttttattaagagaatatctcaatgcaaaaaactagcctacatattttatggatttatccactacttacccagatactcggctctgccctattacccctttttagcgaatttagccaagggggaatgttggttgtttttgccttatttaccgtcccagcttttctatttgcattagtcagctacaaacagcaatatcaccaacgtaacatcattcaaattgcctttttctcaggggtaataatgttcatttacagccttttttcattttcattgatgttagcttttgatgaatacaccagccttgaagatcctattcccctatgggaacaatcccttgccgtgatcttattcgctctaacctttgctttagcaaaagtaatgtacgcactgttggtgttgagattgtttttgccgaaggtgtaagtcgcttacattaatagaatggagctagacacttcgggtttaataatggcgagagttttttagatcattggttatccttatattcaagttaaggcagggtgagaaacttcctcctagtaaatttataggtctctcctagataacgactaaaatccctattaggttaagatagccctatgagcaaaagttatctaagtcagtataaacaaaataaacttattgagctgtttgtagcagatatcactgctcgaacagctgctgagttgataaatgtaaataaagctaccgcagcctattatttccatcgtctgtgattgcttatcaatcaaaacagtctacatcttaagaggttcgatattcaagaacaagtgaagcctggcagtattgtttacaccgatttctaccgaaactatgataagtctgatgtaactgagtttaatcattttcgcatcaatcacactacctacttcgcagaaaaacaaaaccccaaacgaaaagggctaagtccgatacaatatcgaaatcagtcctttgaatagctgtataacttttgaaggtcagatcattttattcatattttaaaaggtgatttgaagacttttaccataaaactttaggggctgacgtagattagccccaataaaaaagtaccccgaagaagaaacccaagccccaatttggctaaatgcacatcagcttcccaaccagtgcttctttttaacaaaactttttcaggagaatatctgtccgtgtagtaatatcctagcactagaacaaacattacaataacaacgcctaattaattttccttcggtacagaatttgataatgcatctacgtgtttttttattgcttcacgaacatgatgattggaataatctacctcaagagaaccatctctatttacttttactctaccatcaaaaattgttgttggctggactttatcagctgatttaacccataatactctaacacaattaaacgttgtttttaaaaaatcaaacgtaactgtaaatagttttaacatagccatcctcatataaaatagcgagtgcataatagtatttaataaatcttatcagatcaaccttaaaacacattattaacatcaactattaacattattttaacacaatcataatggtccccacaatcctacatccaaagagttcaaatcttaaccagacatcaatcaatccagcgaatacagcatattgccagcgatgctgcataatttcttgctaacttatcgtaccgagtctcaatggctcgatattgttttaaaaaggcaaatgcattttcaactaaatggcgatgacgatataaatgtcaccccatatcatcattacccaccgttgaatttcgtttacgagatataactagaacagcttttgcggtcatcagaataaaaccaataggatcgccacaatgatccacagctaaataaaggaatagtagacaaaagtgttgattttaattattggagctgtattagattagctagtataccaaccaacatcagcccctataaataaggttgtaagagcaaattacatttgccctaaataattgcagaaggatcagggcgaagtcattcgcgcctacattttatttacacaatctcactcggcgtaaagaaatacgcaatttcacgttttgctgatgtttcagagtctgagccgtgaactgagttttcacagtagcctaaaccaaacattttacgaatagtgcctagtttgcgttcttcaggtttggttgctcccatcaacaagcggtagttttctacggcattttcgccttctaacaccgcaacaacgataggctcagaaatcataaatgctacgagcggatcaaaaaaatctttgccttgatgttctgcataaaaaccttccgcttgttctttggttaagtgaagcatttttaacgctttgatcgctaagccatttttttccatataacttaaaatttcaccgataagatgacgtttagtcgcatcgggtttaataatggcgagagtttgttggatcatttgttgtccttattattgagttaagacaaggtgagaaatcccaccctgagtaaatttatttcacctgcataccagctgtcacaccgctatcggcagagagcaagtagagatctgcaccgcctgtgccagcagataaaatcattccttccgacataccaaacgacattttgcgtggggcaaggttggcaatcataatcacaaatctgccttcaagctcttcaggttggctgtacgccgctttgataccagagaagacttggcgagtatggtcgcctaaatcgagttcaaaacgtaataatttatctgatttcggcacagcttcacatttcaatacttttgccacacgcagatcgagtttagcgaagtcgtcaatggtgatttctgaggcaattggttcaactttggtttcacaagcggtcatttcttttcctttttttgcagtttctgcttttacgctttcggcgaaaagtgctttggtttcttcaatcacagcgtcaatctgttttttctctaagcgagagaagagcgatttaaacggtgcaatgctatgggcaaatagtggtgaaccgatgttgtcccaacgcagttccgtttgtaaaaaggcttcggcacgttctgcgagttttggtaatactggtttgagatagctcattaatacacggaatagctctaagcccattgaacagaccgcttgtaattcggcatctttgccttcttctttggcaattacccaaggggctttgtcgtcaatgtatttattggctttatccgttaatgccataatttcacggatcgctttgttgtattcacgcgtttcaaaataagtggcgatatgctccgattgtgcaacaaattcatcaaaaagcgcttgattttctagtattgaagccagtttaccttcaaagcgttttgtgatgaaacctgcggtacgagaagctaaattaactaacttattgacgatgtcgctgtttactcgttgtacaaaatcttctaaattgaaatcaagatcttcaatgcgatcattcaatttcgccgcatagtaataacgcaaacattcaggatcgatatgttttaaataagtgctggcttgaatgaaagtaccacgggattttgacattttttgtccgtccactgtcacataaccgtgagcaaaaacgttcgttggtttgcggtattcgcttccttctaacatcgcaggccagaatagactgtggaagtaaacaatgtctttaccgataaaatgatataactcagcatcactctcttttttccagaaatcatcaaagttcaagcccgtgcggtcgcaaagatttttaaacgaagccatatagccgataggggcatcaagccaaacatagaagaatttgttttcgctatctggaatttcaaagccaaagtaaggtgcatcacggctgatgtcccattgctgtaaaccgctctcaaaccactcttgcattttattggcaatttcaggttgaagcgagccagagcgtgtccacgctttcagcatttcttcaaagcttggtaggtcaaagaaaaagtgttccgactgttttaccacaggggtagagcctgacactaccgaacgtggattgattaaatccatcgggctataagtagaagcacagacttcacagttatcgccgtactgatcttccgctttacatttcgggcaagtgcctttcacaaagcgatcaggcaagaacatatttttttcaggatcgaacaactgcgagatcaccttgcttttgataaaaccattcgcttttaattttttatagatggcagaagtgtattcacggttttcttcgctgtgggtggaatgatagttatcgaaactgatattaaagccagcaaaatcagcaatgtgatcagctttggctttttcgattaactgttcaggggtaatgccgagtttatccgcattcaacataatcggcgtgccgtgagcgtcatcagcacagacaaagtgaatttcgttgccacgcatacgctgaaaacgcacccaaatatccgcttgaatatgttcaagcatatgccctaaatggatcgctccgttagcataaggcaaagcacaagtgaccagtatttttctttttggatttgacattctaaatctctctaaaatatagcaaaaaatcattgggattgtagcggaaaaggggggaattgtgtagttaagatttggggagatagggatttttcaacgctatttctggtgtttctcttatttctaaaagttataaataactaataacacattatcttttgaaaaatgaatttttcagataaaatagttctgataaggactggtgcaaagtaatcttcactatccgttaatgctcacctacataaaaattaattacgatcttcataaagagtattaaagcgagaaattactccacccaagtttcataaaataaattttttaaataagggatacaaattatgaacatcaaaaaatcaatattatctactatgcttttatcttctgctgtgttgctctcttcttgtaagaaagatggcactggcggaaattctccccaacataataaagaacaaaatccagttaattcgtcgataggtagccattttagtgctgaaagtagtggaactacaaataatggatttaataaactccctgacagacagacagacagacagacagacagacagacagacagacaatcataatgcacttacgtctcattcttccaatactaatcatcatttaaatacatctaacgattctgttttatcaaatacttcgataactccaaatctgccagctgctccagataattcaatgcctacagatagttcaaattcagcgacttctgatagtcaaaaaccatctgatgagcctaaggccgacagcccaagttctgctgaaagttcaacaacttcaaatgaaccaatcatttcagacaatcaaacaacttcgaacgatccaacaacttcggacagtccaaattctacagataaacctagtacggaaaatactaacaatgaacaagctacagcagagacgacagataagcaagaagtagcaaaagaggatagaaaagaagaagtcgtagaagagccaaaagtagaacatcaagaacaaccacaaacagaaactgaaaaacaaccgcctagagaagaggaaaatccacaaacagaggaaaattcacaagcagaagaagatcctcaagctgatgaattgccgaaagttgaagaacagcctgaagccgaagaaaaggctgaagaggaaaaagaatctcaaagctctgaaattcaaactgctccagaaacccaaactaacagtaatgaaataccaataaataatgaaccgactaataatgaaatatcgagtaataatgatccaacaaataatattactcataatgataattcttctggagaaaatataaatcaagaaaataatgaaaccggcaaagaaaacagttcagaggattcgccttctttcaatcaagatttaactacaataattccagaaaataataatttatctgctggaaatagtgatgataataaaaatactgatacggaaaataatgtatctggaaataattcgctagaaaataatgatgttactttaaatttaaataataattcagaatctacaactccagaaaataatccttctacgcaatctaattcatcaataaatcctgtggataatcagccttgggttaatcctgaagttgagagattagataaaaataattaccagcaaaccgcccaagaaacaaaatttactaatagaattgggattgttgatatggattttaatacacgtgatgatcttggcaaagcctttaaatttgagaatgggctaagtcgtatagttttaaatgcgggtttatatacgtcagcaaacggacataaaagctctcatggtacgatggttgctggtgttatcgatcagaaaaataaaaatgctacgctttatgcttatactgcaaaatccgcttatatggaagctgtaagtgcatctaatcagcattacaatgaagcatacgatcataaggttagaatatttaataactcttacggtaataatccacatagagatagtgtaaaagaaaaaggatgggaaaagttagcaggcttagacctatataagcaattggctgcaatggcagaaaaagacagtatttttgtatgggcatctggcaatgatggcaaaaaaagaaatacaggacagaatgaatatgcaaccatagaaggacacgttcctttaattagagatggagcaagaaaaggctggattgttgtaacctcggtaaatccacaaaataatgggcttatggattatgcgagccaaataggagataaagcaaaaaactgggggattgctgcacatggtgaatggtatttatttgataaacaagtacgaacagaaggaacttcttttgctacacctgttgttactgctgccgtggctaatgtttgggaaaaatttgattggatggatcatcatttagttactcaaaccatattatctaccgctaataaattaaattcgtcagatgtgaccgaagaaccgaatgaacgtgtaggttggggcgtgttaaatcaagaaagggcattaaacgggccagctaaatttgatacaaaacttttaaccaatgataataaaacctatgttgtagcaaaattagattataaacatcataccgaccgcactaaatacacttggtccaataatattcaaggtgatgctggctttaaaaaacaaggtactggaacactttattttactggttcaaattcttatagtggaaatacagttatcgaaaacggaactttggtaattggaaatgaattaaaacaatccacagtagaaatccagtcacagggaacattattaacgaaaaatttaaataactctcaaacagaagttaaaatagtaaaaaatgtagataataaaggttccttggaggtttatggaaaggggttaattattgagggtaattatactacttcaaataatgccagaacggttattgatatagataaatctaaattaaaagtaaatggaacagttaatttacaaggttcctatattgtagccgatgttgaaaatattaatgaagtggtttcaagagatcctcaaacaaaaaccattattgagtctcaaaatcctattcaaaattataatggagattacaaaatatcggatcgtgctaacccttatattgatttaaaagaaattaaattaaaagaagggaataataaagaaattattgcaacctataaacgaaatgatacagaatttgtattaaaatctgccaatgaaagttcattaaagaatgtttatactgcgagaagtttagatcttattttagatagtgcgagtgattcaggaaacacaaatggaaacctcagaagtacggcattatcctttattaatgctaaaccacaagcggtagcttctgcagtagattctttaagtggtgaaatatatccagcggtacatcaagtagcactgaatagtattaaaaccttgaatagacaaattgctaaacagcaattctcaaatattcaagatattaagccttatcatatttatactcaattagctacacaaagtttaaaactttatcaggatgataattttggatttgcagatttaaaaaatagtgcagactcacaattagttggtatagataagcaatttaatgcctttacatttggtatgggattgcaacgagttcatcaaaaattatctcctttatctagtaaagatcaacaagttggaaaagtagatttaaaacaacacagtttcgccttatacggaaaatatgattggaataaatggtattatctcagccaaatcagttttactgatattaaagggaaattagatagaacattgttattgcctaatggcacacagacaattaaagctgatttaaaattacaaaattattctttttataatgaaaccggattaaatctacaatatgaaaaattaagatttaatccatatgttgcgttacatattaaccgtttaaaacaggattccattaatgaaaaagaagatttagcattaagtattgataaatatcataaaacccattatggatatgaattgggcttaagattaaatcaatcattatctgaaaaacttaatataaatctagacatctcttatctttataataagaacagtatggataatatagtaaatggaaaatatattatttctgacactgaaactaaattatatggaatgagattaccaagatatgaatttaaaactagtttaggtatgggctattatcttactgaaaacctcaatatttacgctaacatagcttattatagattgtggaataacccaatgaaatcctattacaaagaaggaaatattggcgcgaagtactatttctaatagtaatatgataaacaatcacttgaaagcacattcgtaaccctgtggaaatcccacggggactttttgcttaatcattgctatattctttattttcagactttggcaaaatgggcagttttttgttcatatttcaaaaagagggcttaaagccttgtactataaggctttaagccactttttagcaacaaatttgtctattacacattttttgccgaatcaaaccgcttgttgtaagggttatttatcgaatttcctcctttccatcacgttaatccgttattttatttatcaatacaagcggtgagtaatgtaaagaggaatgaaaaccacgcttcctataccccaaacaagaaccattccagtagcttcactatctaaagttattttttctgaatatgctataaattgtgtttgtagtggctgttctaatttggctttgttcagaactgcatcttgattttcaattttgaccaacttcccataaatgtcataaaactgttctgatgatttcttattatgtaaagaagtgagttttaccctagactcaatattaggtgttttcatttgatttctgatataaataatctctgctttagtaacagatttcattttttctgattgaataaaacgagaataaattcggtggttttccgctcttgataatcagcattctccttgttactgctttcaaattaataactatgcaaatctccgacaacatataatttattatcagcaataaaaaatgctcggattgtttctgttttggtattttcatcttgatactctgttttagtacaagcggtcataaaacataaaatcaaacagtaacaaaaaaagcgttttaagatttgcatagttttctcctcagaataactatgaaatagccaccacatctggcaatttcactaactgattaagtagtaattccatcgctctttcactctgaacggtgacatttaacgtaattcccgaaccattattttctgcattgagtgatagcacttcaaacccacggtggcggatcactctgagtaaacgctcaagggtttcagggcgtttattagctttgataacgaattgatattgttgcatttttcttctccttaaaccccaatgtcttcatctaacatatctgtattgcacgcatttggtggaacgagtggccacacattttcttcatctgggatacaaacgtgcaataaatacgctcctttgctgttgagtaagcggtctaatgcggttgaaacttcccctgctttttcaatgcgttctgctggaatgtcaaaggcgttagctagcatcacaaagtctgggttgtcatctaaaatggtttgactgtggcgaccatggaaaaagagcgattgccattgacgcaccattcctaaacgttggttgtcgagtaacagaattttgacaggtaaattgccacgtttgattgagccgagttcttgaatattcatcataaaagagccatctcccgtaatcacaatggttggatccgttgggcgagctttgaccgcacccgccgctgctggcagaccaaatcccattgtgccgaacccagcagaagtgatgtagttttcaggggaataatgctgcatatgctgtgctgaccacatttggtgctggccaacgtcagtagtaataatcgcattttgcggtttgcgttgtgaaagggtgtgtaacaacgcccaagggtcgatttcgccttcgcctacattttcttgatagctgaagtcaaaatccgctttcagcttacgcacatcagctcgccagctttcaatctctaacggttgggtaagtgcggtcactgcctcgattaaatctccttgcaatgctacatctgctttgcgtagcttgttgatttcagccacatcaatatcaatatgaatcactttggcgtgcggtgcaaaggtgtcaagtttacctgttactcggtcgtcaaatctagccccacaagcgatgagtaaatcacattcttgtactgcatagttcgccgctttcgtgccgtgcataccgatcattcccatatagagtgggtgttgtggtggaatggttcctaagcctttcaaggtagaaacagacggaatatttgcaacatctaggaaagatctaaccgcttgcacgccatctgccataccaacaccaccgccaacataaagaatagggcgttttgcttgagctaacaaggctttggcttgtgcaagtgccgctggattttgtaccttagccgccactttttcatagacaattggggaaagtaatgttggagcgaattgcacatctttaggaatatcgacaagcacaggaccagggcgaccactttgtgcaatttggaacgctttggcgataatttcaggtagttcatcaatgttttgcacgatgaaactgtgtttggtacaagcaagggataagcctaatacatctgcctcttggaaagcatctgtaccgataaaggctgaagccacttgccctgtaattgctacgataggaatagaatccattaaggcatcgcctaagcctgtaactaggttggttgcccctgggcctgaagtcgcaatacaaacgcctgtcttgcctgttgcccgagcataaccgatagcagccattgctgcaccttgctcgttacgacaaagtagatgatctaaacctgaatcgtaaatcgcatcatagacaggcataattgccccgcctggatagccaaaaagagatgtcacaccgtgagctttcaaacactcaacgactaaatttgctccgttcataaattacctttttaatgttgtgtcgctactttagttaaggcttttatgtaataaaaaaccctcactaaaactagcgagggtttgtggatctcattatacaattctaattgcgagccaacttaaccctcgcggcgataataatcaccacgaggttaataataatcaggctaacaagagaacgtaatgtcattttcatttatcaataaaagcttgagtagctatataaatagcatattttttgtataaaacaaataaattttttatctctttatgaaaaaaagcaaacgattagctttaaatagactaaatttacttgcgtagtggggggctagggttgaaaatgcccaaattatcactatttaatcagccactaacttctataaggaatttctatgccattacttctctttttagctgggctatttttatacatctacattgaaatctctctattagtaagcgttggctctgctatcggggttttacccttgattttattaatgatcactatttcagcggtcggtttatggttggtgaaattaagaggaataattaccatagtgcagatccgccaagagatcgcacaaggaaagatcccagcacaagcggtgacgtcttcgatcttttttgcaatcgcaggggtattgctgattatcccaggttttttgagcgatattttagcgttattgcttctattgccgataactcgccaattgctacaagcaatgtttatgaaactgtttgcaagtcgtgtgaaatttatgtcttttggctcaatgaacagaacttcctctcaaaataatacaacgtttgaagcggaatttgagcataagcaagatgaagataagtggttgaaataatgataaatttcataatgatacatatcaaagattcacgacatataatgagattcaaaaatcaatatctgaggtctatttttcctttcgcaattgcgataaaaaagagtaaaattagcctttattttgacaagagagaaacaaaatggcaaacattcgtttagcaattgcagcagattttttattagccgagaaattattagaagccttagaacaaagtagtttagattttgaacaaatttcagccgttgaattggaaagttttggcgaagaacattctctgcgtttcggtgcaaaagctgttgagcaaatcgctgttgaagatgtcaattggtcgcaatttagtcacgttctctttgcaggcaaaatggcaaatgctgaattgctggctcaagcggtacaagcaggttgtgtgattttagatctctatggcatttctgcattaatcggcaatgtgcctgtgattgtgccaagtgtaaacaatgaaatgatcgccaatgtgcgtgagcgaaatattgttgcgttagcaaatccacaaatcagccaattagcacttgccttaaaaccgttgttggaccagcctattcaacatatttttgttacatcactattgccatcgacctattttggtgatgaaaaagtgcgtgagttagcagggcaaactgctcagttgttaaatggtattccccttgatgatgaaaaaccacgcgtggcgtttgatgctgtacctgccaatgtgcaaggtgatgaaaaacatctgccgttctctcgtgcctttgagttacaacttgcaaaagttctgccaaatctaaccgctagtgtgactttccattccgtgcaagtgcctgttttctatggtatttcacagatgatcagggtgcaatctgagtatgctttagatgcaaccgcattaagtgagcagtggcaacaacaagcgtgggtaaaatttaactctgataatgtaattacccctgttaaaaatggtgaagatgaagaaacgaatctcttacagattagccaactactcaataaaaatgaaaacgcactacaattctggacagtggctgatgaacagcgttttagcttagcgttcttggcggtggagttgttgaaagaagtaatcactagctattaacatagtcggatctaaaaatacaaacatttgatataccatcactcaatcacatagcaatatattctcgtagatatggaacaaaattcttctttaactcagattctggtagctactgctgctattgtaattattttggcgggtattaaattatccgttgagatcgttattcctttcttattatctctttttattgcaattatttgttctcctattatcaaatatctaacctctcataaagtccctttgtggctggcaatcactatactccttattctatttttacttggattcttttttctggcaggactaatcaacagtacagtacaagaatttacagcatcaattccacaatacaaaattcttctatctgaacgtattgctgccgcaatgctccttgttgataactggaatatcccggtttcaatatctcgtgaacagatccaagaacagctagacccaagcattattatgaactttgttagtcgcttattacttagcttctcaggcgtcgtcacaaatatttttgtactcttattagtcgttgtgttcatgttatttgaggctccaaccgctaaacataaacttatcgtggctcttagaggcaataaaaatgtggaatcggaagaaagccatatcaaccgagtattacagggagttattagctatcttggcataaaaacgattgtaagcctgcttactgggatatctatttgggtgttacttgaaatagctgatgtacaatatgctgtattatggggcacattaagcttcctactcaactatattccaaacataggttcaatcattgctggtgtacctattgctgtacaagcatttctattgaatggcttttctgttggattgggagtatccgtcggtatcattgcaatcaatatggtaattggcaatattctagaacctagaatgatggggagaacccttggtctctcaactctcattgtattcttgtcactacttttctggggatggttactcggtacagtaggaatgctactttctgttccattgacaatggctctcaaaattgcattagaatcaagccctaaaacgatccattatgcaggcttattaggagatattaataaacgctaatgctcttatttttgcgctttaaatacattaaataacctatatgtttcttatagcactcaacctaaatatttttaacatctacgcaaacgattgctttttggtttatctttgtgtacaatcttcgaccctttaatcatactatatatttattgaggtttttccattatgtctcttctttctcgttttcaactggcagaacgtggttctaatgttcgtcaagaggttattgctggtttaactactttccttgcaatggtttactccgttatcgttgtgccaaatatgttaagtgcggctggctttcctgctgattcagtatttattgcaacctgtttggttgctggtttaggttcaatcctcattggcttatgggcaaatgctccaatggcgattggttgtgctatctcattaacagcttttactgcattcagtttagtgctaggtcaaggcattagtattcctgttgcattaggtgcaatcttccttatgggtgttttatttaccattgtttccataacaggtatccgtgcgtggattttgcgtaatctgccatctagtattgctcacggcgctggaattggaatcggcttattccttttattgattgcagcaaatggcgttggtttagttgtcagcaaccaagcgggtttaccggtaaaaatgggtgagttcacttcttttcctgtaatgatatctttagttggtttagctgctatcattggtttagagcgtttacaaattaaaggttctattctttgggttatcattgcaattacaatcatcggtttaattttcgatccgaatgtgaaatttggcggtgaagtatttaaattacctacctttggtgaaaactctcaattcttaaatttagatattgtcggtgcattgaatgcagctattttacctgtggtctttgccttagtaatgactgctatttttgatgcaacaggtaccattcgtgctgtagcaggtcaggcaaatttattagataaagatggacaaattatcaacggtgataaagcacttacttcagattcattaagtagcgtactttcaggtttatttggtaccgcgcctgcagcagtatatattgaatcagcagcaggaactgctgttggtggtaaaacaggtttgactgcggtcgttgttggcgtgttgttcttattaatgcttttcttccaaccactcgcatttttagttccaggttatgctactgcccctgcattaatgtacgttggtttattaatgttgagcaatgtatctaaattagactttgatgactttatcggcgcaatgtcaggcttagtttgtgctgtgtttattgttttaactgcaaatatcgtaacaggtattatgttaggttttgcaaccttagtgattgggcgtaccatttcaggcgaatttaacaaattgaacgttggtacagtagctattgctattgcattagttgcattctatgcctttggttttgcaatttaagtcctcaataaagatattttcctctttttaagaaaaatatttaacagaaatagctcattgtatgaaagataggatactaaatttatcccaacatcatccttagatactagaatgaaatagaaagtcaaacgcctataaatagaatctattcataggcgtttttatcacactacatttatcaatgtaatttctattattttactttttgtagcttatggtatgcatctagtaatttttgatgagctgacatattcctcaaagtttcatcagaaccaattaaaccatggaacggattttctccctgcattatattccaaacaaaatctacagcatctttcccatacattctgttaaatatcattctatactgctcaggttccctatcctcatccaaaaataattcaattacactaattaaacaacgatagtaattgtttctttctgctgaaaatacggaagcattcatattaactgtccaagttgcccaatctaatgcctcttcaagatttcctaaagccaaatgaagcatagattttaattcaccaatacgtaaagtttgtagtgcgcttcctttttcagctaccactccaataaattcacgtacccgcgtcatatcatcaataccttgctcatccagcacgtccaatagctcttgataaatttctttctcatgatggaaatagggtaaatcaagcaacatttcacgccattccattcccatattattattcgcatagatcaaatcgtcaggaggataaatattagacattccaggagcaattatacggcaagcgtatacacctaaatgttcatagtccataatataaacctcttgcttataccggctgaaaatttccatcaaattagcaaattcctgctctgttgtgcctgaaaaatcccagtgagtaaattcataatctggttctgatttaaaaagatcccatgaaatctgaccacttgaatcaataaaatgagtttccaaattcgcataatctgccacatcatcattattaaatgatggtggagaaaacacatccaaatcttttaaactacgcccctgcaaaagctcagttactgtacgctcaaatgcgacttggaaattaggatgagcaccaaaagaagcaaaacacgtaccattcctaggattaagtaaaactacacagataactggaaattcgccacctaatgaagcatcatagcagagaatcggaaacccttcttgctccaattgctcaatcgaacgtttaatcgtcggataaccatcaataatacactgcggaatttcaggcaagctgattgcctcagtgataatacgatttttgataaagcgttcaaatacttccgatagtccctgcactctggcttcattcttagtgttgccagctgacatcccgttagaaacaaataaatttccaataatgctttgtggaatatatacagtatgaccatcagactgacgaatataaggtaatgcaactattcctcgttctgaattgctagactgtagatctaccagaaattctggtgtcaattctccatttggattaaaatagtcatgtagaaatggatccaatattccttcaggtaattccgtttcattttcaataggaaaccatttttcatttggatagtgaacaaattcaccttcagcaatttcccttcctaaataaaaatcagcccaaaaataattagtcgataaacgctcaaaatactcccccaatgcggaagcaagagctgctttcttacttgctcctttaccatttgaaaaacattgtggacaatcaacatcacgaatatgtactgaccatacatttggtacaggattaagccaagaagcctcctcaatattaaatcctaattctttcaacttagtctggaatctttcgatgctttcttcaagggctgcatctttccccacaataaaggttttttctatcattttttctcttaaaatgaaacggttttactctatttatataggatgtagacattggaaaccaataaagaaattcataaccacatcttaaatctcttctaccagttagaataaattgagcggaaaatttccgcccaattcatatgttaaaaatccattaattctttctctttgtctgctaaaacctcatccacttttttgatataaatatctgtaatcttttggatatcatcttgagctttacgctcatcattctcactaatctgtttttctttctctaaagttttaattttatcatttgcatcacggcgaatatttctaattgaaactttaccttgttctccctcaccttttacaattttaattaaatctcgacgacgttcttccgttaatggaggaagaggaacacgaatagtagttccagccgaagaaggatttaaccctaaatccgaagttaaaatcgccttttctaccgcactaatcaacgaacgatcaaatacagtgactgctaatgtacgagcatcttctgcgacaacattagctaattgacgtaatggtgttgcggacccgtaatattccacttgaatagcatctaataaactaggctgagctctacctgtacggattttagaaatatgtccttttaaggcctcaaggcttttttccattcgttcttgagtatctttcttaatttcattaatcatagtattttcctttgattgaataacataaacctattgattctacccaatttcattctattttcctagtactaagtttatagggtttgtggtagacttatttgacttaactcatcacaagagggaatccttatgtaccaacaacaaattttaatagaattacaagaagcgcaacaagtattaaatgactttattaatgaccaacataatcttaaactaattcaagaagcagctttactgattactgatagttttaagaacgggggaaaaatactttcctgtgggaatggtggctcacactgtgatgctatgcattttgctgaagagttaactggacgttatcgtgaaaataggcctggatatccagccatagcaatctcagatccaagccatttaagctgcgtaagcaatgactttggatatgaatatgtcttttctcgttatgttgaggcaatcggacaaaaaggagatatcttgttttgcttatcaacatcaggaaattctaaaaatgttattaatgcaatcatagctgcaaaagccaaaggaatgaaaattattgcaatgacaggcaaggatggaggaaaaatagcagaactagctgatattgagattcgtgtacctcattttcgttatgctgatcgtattcaagagatacatattaaagtaatccatattctcatgatgttaattgaatttgaaatggcaaagtaaagaataaaaaatccaacttaaataaatagttaagttggattaattcgttgaatagcgttaattaagcaatcgtcgtaccttccgttgtacccgtcacaacttgtttcaacgcaccagctttacccatattaaatacacgaattggcatattatggtcacgggcaagagtgaatgcagctaaatccatcacttgcaattctttttcaataacttcagcatagcttaaatgttgataaagttttgcatctggattttttgcaggatcgcaatcatacacaccatctactttagttgcttttaagacaacatcagcttcaatttcaataccacgcaagcaagctgcagagtctgtagtaaagaacgggctacctgtacctgctgagaaaatcacgacacgtttttcgcgtaacattttgatagcttccgaccagttgtaagtatcacaaataccgtttaactggaatgcagacattaattttgcattgacatcagcacggtgtaaggcatcacgcattgctaaaccgttcattactgttgcaagcatacccatatggtctccaacaacacggttcatacctgctttagcaagtttagcaccacggaataagttaccacccccaagaactacgccgacttctacgtccattgcaagcaattctttgatctctaatgccattctatctaagatagatgggtcaataccaaagccttcttcaccttgtaatgcttcaccacttaactttaacaaaatacgtttataaataggattgctcattttgacctctgtgtaacggttggggaaaaaaatcgaaatattatagattatcttaatgacagatcaaagtaggcaggcggatagaatttccactttattttcggtaaaatcgctatccctttattttcgttttgctcataatgaatataacaaagatactcgctactctcattagttttggtttagcttatttagttagttacctaatgctacttggttcgggcttttttcctaatcctgaaatcagcaatgtgctgttgctggttctcgttattctatttgcgaatgcctctaaaaagacgttcttttatctgcttttgccgattgtcactttatatgccctttacacgcctattggtttgacctttggtccaccgtcgtatcaatatgttgcttcggtttttgctacagatatacaagaaagcaaagagtttttcagccaaatccctctcattaactttgttgcttgtgctggcatttttatatcactgttaggatttcgttttattagtcaaaaatggcaaattcaattccacaaaaataaaacctttcttgcgttaggagttgcattagtttttatctctactccgcccttcaaatttctacaagaaggaagtagtgcgttcggtaaagtcaaaacagaattagaccgcttgaatagtatgtccattcagagtgaatggggaacgtcacaactcaatgcagaaagtcgttatgatgattacattttagtgatcggcgaaagtgctagaaaggattatcaccacgcctatggctaccctgctgaaaatacaccgtttatgagcagtgctaacggcattttaattgatgggctgaccgcaggcggaaccaacaccattgcttcattaaaattaatgctcaccaagcctgatacacaaaaatgggaaggggaatacagtcttggtatggtagatttgattaaatccgcagggattaaaacctactggctgtcaaatcaaggctatctaggcacttttgatacgccagtttcttctcttgctaacaaaagtgatgaaaaattattcttaaaatcaggagactctttccatcaaaatatcagtgactttgatttattacctaaatttgaacacattattgagcaaaaaactcatagcaaacgttttgttgtggtacatttatatggctcacaccccatcagctgtgatcgtttaactgattaccctaaaatatttgatgatgaaaaaataggcaaaaagtatttcaacgtaaactgctatgtatcgtccatcaaaaaaaccgacgaagtgttaaaacgcttatatgaagcccttcgcaaaaatgagcaacaatctaaccgctcgttttcgatggtctattttgccgatcacggtttagctcaccatatcactgaaaatgacattgcaatccacaacagcagtggcaaaagtaagctacactttgatgttccgctctttaaaatatctagtgatgataccgatagaaaagtctataaagcgatgaaatctggcttaaactttaccgatggtattgcaaaatgggtgggaattagtaatcctaaattgaatacagaagtcgatttattcagccctcattcagacaaggaagattatgggctaaaaaaattgattgatggttttgaagggaaagtggatcctgctgtggttattcctaaggatgagtaattctatatcccaaaatgattttccgacagcataagtgcccatagtaatacaataatcaatttagccatttaaaaatctagacgtttagatgtctaaaatttcttgacgaaacgatttcctattcgtaaacttaaaactattcaaaaacaagcggtcgcttttttaccgttttttgcaaggatttttatggcacagcagattactctttttgatgatattccccttgagcttgctttaggcggaacactttcgcctatcaatgtcacttaccaaacctatggcacattgaatgcggaaaaaagcaatgctgtattgttgtgtcacgctttaacgggtgacgccgaaccctattatgcaccgcctgcggataaaggctggtggcaagattttatcggtgcaggattagcttttgataccgataaatacttttttatctgctcgaatgtgcttggcggttgcaaaggtacgacaggcccttcgtctatcaatccaaatacgaataaaccctacggcagtcaatttcccgttatcaccgtgcaagatattgtgaaggtgcaaaaagccttgatcgataaactcggtattactcagctacaagcggtcgtgggtggctcttttggtggaatgcaagcgacacagtgggcgattgattatccggaacaagtgagaaatgtggttaatctctgttcttcgcttaccttgagtgcagaagcaatcggcttcaatcacgttatgcgacaagcggtgataaacgatccccattttaacaacggcaattattatgagagtacgcccccagataacggcttaaaaatcgctcgaatgctcggtatgctcacctaccgcaccgatgtacaacttgccaaagcctttgggcgagaagtgaaacagacgggaacgatttggggtgatcacttccaagtagaatcttatttaagttatcaagggctcaaatttctagatcgctttgacgccaatagttacttacgcctgttaagagccttagatctctatgatcctgctttaacctatgcaaacgagcaagaagcactcagtcgcattaaagcgaattacacccttgtcggcgtaacgagcgatcaactgtttaaacagattgacctacataaaagcaaacagcgtttagaaaatgcaggcattaccgtcgatttttacgaatttcattccgactttggacacgatgcgtttttagttgactacccgttttttgaagagatgattaagaaagggatcgagaaataattatccacctttcaacctattcggcaacaccgactgaaacagctctcggcttttcagcggtgctgatcccaaataaggctttaaagcaatacgggtgaaacgttttgctgactgtaaggtttctttctctgaaaaattcatttctgcaaaagctaataaatctttgccgataaaggtatagttattttgtaataaagaggcaataaagccttcattttctctaaattgatagctcatttttggatcgacaggcttacctgttgctgcacaatggcaaaaatccaccccataacctaacgctttaagtgtttgaaattcaaaggtgcgtaagatcggctcgatctcgtttggctggcttgccaactttgtcatacagtgtagataatgctgaaataattcagggtaagcggtgtgattttccaaaactcttgcaaggacttcattgacataaaaaccgctatacagtgccagcgtttgcatcgggagggttaaagatgcaggttcagctttggtaagtgttttgagatcacctttacccgtccatttcagcaataaaggggtaaagggttgaagaacggatttcaatggcgaacgtggtcgtcttacccctttggcaagtaaggtaattcgcccgtgattttcagtgaaaaaatcaacgagtaaactgctttctctgtactctctgcgatgtaatacaaagccacgttgccactgttcgatcattattcgtcaatataacccaaacttcttaacgcacgttcatcgtctgcccagccagctttgactttcacccacagttcaaggtgaactttattatcaaataggcgttccatatccgcacgagcttcagtgccgatcactttgatcttctgaccttggttaccgatcaccatttttttctgcccttcacgttccactaaaatcaaaccgttgatttcataagtgccacgttcgttggttttaaattgctcaatttcaaccgtcaccgaataaggcaactcttcgcccataaaacgcattaatttttcacggataatttctgacgccataaaacgttgcgaacggtcggtgacataatcttcaggatagtgatgaatgccttctttgagcgactcacgcacaaatttctctaaaatatatacgtttttgccccgttgagctgaaatcggaatgatctctttaaatgggaatttctgcgataaagcggtcagatgtggcaataattcttctttttccttgatattatccactttgttaatcgctaaaatcacaggggctttggtcgaacgcaatttattgagtaccatctcatcatcgtccgtccacttcgtgccttctaccacaaaaattaccatatcgacatcgccaatcgcactggctgctgcacggttcatcaaacggttaatcgctcgtttttcttcaatgtgaagccctggggtatcgacataaatctcttgatacgccccttcggttttaatccctaaaatgcggtgacgagttgtctgagctttgcgagaagtaatcgaaattttctgtcctaaaattttgtttaatagcgttgatttccctacgtttgggcgaccaacaatggcaataaagccgcaatatgttttttgatctgtcattgtgttctcttaaataaatacaaattaaaatggtgggtcaagacccaccctacattaggttattttattcccaacacctttatcacctgcaatgccgcatcttgttcggctttacgacggcttgtgccgttaccgataaagatttcatcaactttttcgactttacaactgactttaaaggtttggttatgggattcgcctttaatatcaatcacttcgtaagtcggtagtggtagcttacgcccttgtagatactcttgcagacgagttttcggatctttttgcgcttcccctggttgcatatcatttagaagctgttgataccaacaatgcacacgttccatagcccgatcaatcccagcatctaaatatactgcagcaataatcgcttccacacaatcggataaaatagactctcggcgataaccgccactttttaattctccagcccctaatttcatatactcgcctaactcaaactgacgagcgacaaccgcaagggtctgttctttcaccaatgctgcacgcatacggcttagttccccttcatcagctttcgggaatttttcatataaggctttaccaatggcaaaatttaagatggaatcgccaagaaactcaaggcgttcattattttttgacgcagcactgcgatgagtgagggcttgggtgaggtaatcaaggttagcaaattgataacctaattttttctgtaatagttctaattgcattttagtttatcttcatagaattcccccctttgaaaaaggggggctaggggggattttgctaacattgaataaaattcacgctttaaaaatcccccttaatccccctttttcaaagggggaaatgttctctttatttaatcgccgtaaacattctctcaaaacgtaatccgtttggaaattcgttcggtttcttatcaagacttaaccaaatcacacttgctttaccgaccatattcttttcaggcacaaatccccagaaacggctgtcttcgctgttatcacggttatctcccattacaaaataatgcccttctggcactacccattccccagcaggaataccgtcttgtttgaagaaataaggctcatagttaaaggcgtgtggattatttaaaatctggtgagtaacatcaccaatttcggtacgttcaacttgcatttcaccgtggtagaaaaagtcaggatttggtgtaccgccttcgtatttaaacaccacttctttacccgaatcgccgtgaacaacggttaaattacgggtatgaaaatcatatttcacatggtcgccaccgacacccacaacacgcttaatataatcaacgtgtggctgttttggtgctttaaataccacaatatccccacgttcaggcttacccatcggaacaagggtattttgccaaatcgggtctttaattccgtaagtaaacttattcactaacagaaaatcacccacgcgtaatgttggctccattgaaccgcttggaatttgaaacggctcaaaaataaatgaacgtaaaatagtgactaatgctaacaccccaaatagtgaagcaaaaaaatcacccactaaggaacgtggttgaattgctgctttttcttctgcggtgagcggtttgcctaaacgcttttcttcacgctcaatcgcacgcaagcggcgaggttcggcactaaatttgtaaaatgaccaaaagccaccacaaataacaactaaacctactaatataatggaaatcgtgtttggcaattgcattgagtccaacactttccaaataccgtacaatactgcaataaaaccaatggttaaaatattgctcatatttaaaattcactccttttggaatttatttactatccaaaatgtagggacacactgagtgtgtccattgcaacatttatcaatagaatagatatgaatgttgtatgcggacacactcagtgtgtccctacaatatctattcactaatccttcccaacgtgcaaaatcgctaagaacgcttcttgtggcacttccacgttacctaaagatttcatacgttttttaccttctttctgcttctgcaacagttttttcttacggcttacgtcaccaccgtaacatttcgccaatacgtttttacgcaactgcttcaccgtcgaacgagcgataatatggttaccaatcgccgcttggatcgcaatatcaaactgctgacgtggaattaactctttcattttttccactaactcacgaccacgataaggggcattggctttgtggacgattaacgctaacgcatcgacacgctcgccgttgatcataatatctacacgcaccatatctgccgcttggaaacgtttgaaaccataatccaacgacgcataaccacgcgaagtcgattttaagcggtcgaagaaatctaacaccacttcacccatcgggatttcataagtcaatgcgatttggttaccgtggtaaaccatattcgtctgtacaccacgcttctccacacataaggtaatcacattacctaaaaactcttgtggtacaagcatattacattctgcaatcggctcacgaatttccgcaatattgttaatcgcaggcaacttcgacgggctatctacatagacaatttcgccattcgtttgttccacttcatagactaccgtcggtgctgtggtaatgagatccaaatcatactcacgttctaaacgctcttgaatgatctccatatgcaacaagcctaagaagccacagcggaagccaaagcccaatgccgttgagttttctggctcatagaaaagcgacgcatcatttaagctcaattttgccaatgcatcacgaaacgcttcataatcatctgagctaatcgggaataaacctgcataaacttgcggttttacttttttaaagccgggtaacacttcgcttgcaggattgtgatgatgggttaaagtatccccaacaggtgcgcctaaaatatctttaatcgcacagactacccaacctacttcgcctgtttttaattccgtagtatcaacttgttttggcgtgaaaataccaagacgatctacttgataagactgccctgtactcatcactttgattttatcgccttttttcaacacaccatttttgacacgcacaagggaaaccacgcctaaatagttatcgaaccacgagtcaataatcaaggcttgcaacggtgcatcaggatcaccttcaggagctggaattttcgccacgatttcttctaaaacgagatcgatccccacgccagttttcgctgagcaacgcaccgcttccatcgcatcaatcccgacaatatcttcgatctcttctgcaacacgctcaggatcagccgcaggcaagtcgattttgtttaaaatcggcaccacttccaaatccatctcaattgccgtgtaacagttagcaagagtttgtgcttccaccccttgcccagcatcaacaaccaacaacgccccttcacaggcggctagggaacgagaaacttcataagagaaatcgacgtgtcctggcgtatcgataaagtttaactgataggtttgaccatcttttgcttgataatttaaggtaacactttgtgctttaatggtaataccgcgctcacgctcaagatccatagagtctaacacttgagcttccatttcacgatctgacaaaccgccgcaagtttggatcaagcggtcagataaagtcgatttaccgtggtcaatatgagcaataatagaaaagttacgaatgttctgcattttcataagggcagtaaatgtcctattgtattgttattgataaaagaaaaataatcggcggattgtacctgaaaattacaggaaagggaaaaggaaaggagaatattagaatgaaaatttataaaatagagaaaaatctagacctagtaaacgactatagccttcaatataagactatagtcaattttatagcagctatttttctgcttatctaaaatacttgactgatgtagttaagtcttttactagtgtttaactattaaaagtatacaaaaattctagttattcttctcatcagacatacttgccgctgcggtaaatagtacgtcagttgatgagttaagtgctgtttctgctgaatcttggataacaccgataatgaagccaacgccgataacttgtgctgcaacatcgtttggaatgttgaataagctacacgcaagtgggattaataataatgaaccacccgctacgcctgatgcaccacaagcacatactgaagcaacaacacttaataatactgctgttgagaaatctggtacgataccttgagtataagccgcagctaatgttaatacggtgatggtaattgctgcgccagccatattgatgttagcaccaagtggaattgcgatagagtaaatttcttctttgatgcctaaacgttttgctaatcccatatttacagggatatttgccgctgagctacgagtaaagaatgctgtcacaccactttcgcgtaaacaggtgatggtgagtgggtatgggttgcggcggattttccagaacactagtagcgggttaagaatgaatgccacaatcgccattgcacctaataatactgctaatagacgagcatagccgataaaggcatcagcaccgttagttgccattgtttctgccactaagccgaataccccgattggtgcaaatgcaataaccacttttaccacgaaagataccgcatcagagaagtcatttaataaaactttggtgcttggtgctgcatgacgtaatgcgatacctaagccgatagaccacgcaagaataccgatgaaattaccgttagtaattgcaccaagtgggttatctactaggttgaaaataacggttttcaatacttcaccaatgccttgcggtggtgcaagtccatctgggcttgtgaccaattcaagggtcgttgggaataaatagcttaaagtaaccgctgttactgctgcaacaaaggtacctaagccatacatcaccaaaatagattttaagcggctatcgctgccaacttctttgttagcaattgaagccattacaagaacaaaaactaaaatcggtgcaattgcacgtagtgattttacaaagaattgtccgagaaccccaacgcttttggctgcatctgggctaactaatgctaagcagatacctagcactaaacctacggcaatgcgtaatactaaattaccgccaaggatttttgaagataaagattggttactcataaaatttcctgtaagacaaataaaaaaagacttcatttaccaaggtaaatgaagtctgcgagattagccgaaaatgtagaataagggaatagcaagcggcaatttttctgcaaaaatttttaaaaattagaattttaagaaaaaacaccttaaaaatttaataaaaatctccgagaaatgataataactattaaataaacacctgttctgtcacttgataaccttgcggaacctctgctttatcatcaaaggttacaaattcccaagcattttcattcgctagtacagctcgtaataatttattatttaagccgtgacctgatttataggctttgaaatcacctaaaatattgtagccacacataaataaatcaccgacagcatctaacattttatgacgaactagttcatctttaaaacgtagcccttcctcattcaaaatgcggtattcatctaaaacaatagcattatctaaactaccgcctaatgcaagaccaatggattgaagatattcaacatctttcataaaagtaaaggttctagcacggcttaattgttgaataaaatgttgtgctgaaaattccattttgtagttacgcacttctttggtaatcattgggtgtgtaaagtcaatggtaaagtctaatttcaaaccgtgactataaggtttaaattcagcccacttatccccttcttctactcgtacactttctttaatacgaataaattttttcggcgcgtcttgttcttcaatacctgcatccaataagagatagataaaaggacttgagctaccgtccataattggaatttcggctgcatcaacttctacaattaggttatctaaacctaacgcagacattgctgcgtttaagtgttctactgttgaaatacgcacaccttcatcattgatcatacaagtacaaagttgtgtatcacggatagattcagcacttgccaggaaataaacgacaggcttaagatctgttcttgcgtaaataatccctgtatttgcaggtgctggacgcaacgttaaggttactttcttgccactgtgcaagccaatacctgttacttttgctgcttgtttaagggttctttgtttaatcatatcgtttccttatttcccgaaatggttattgaccatttctcataaacccagggattgagcttggggaaaacatttgagctgtatctacttgttgtggtttctgaacttgctgctgttgagtatattgtgtttgttgagaataaccacccatattattcataaaatcaggttgagttctttgaaatcctgtatttatattctgttgaggttgttggaattgcggtaccgcctgaattgatggaatttttggcatttcatctggctgaccaatacctgttgcaactaaagttacacgaatcttaccttccatttctggatagaaagcagaaccaaaaataatagctgcatcaggatctgcaaagctagtaacatattccataatggtattgacctctgcaagttcaatatcatagccagaagaaatattcacaagaatgcctttagcacctgataaatcaacatcttccaataacgggcttgctacagcttcttttgctgcattttctgcacggttttcaccctctgcaatgcctgttcccatcattgctctacccatttccgacatcacttttttcacgtctgcaaagtcaacgttcacaagaccttcggaagtaatcatatccgtaatacctaataccgcattgcgtaagacgtcatttgcaacgccaaaggcttcattaaattttacacttttaggtaacacttttagtaatttatcattttggataatgatgagtgaatccacatgttttgcaagttcacggatcccttgttccgcatagttagaacgttttctaccttcaaaagagaaaggtttagtaacaataccaactgttaatgctccttggcttttagcaatttcagcaattacaggagctgcaccagtacctgtgccaccgcccataccaacagcaatgaagaccatatcagcacctgtaagcatattcgttaatgcttctctatcttcttcagctgcttgatgaccaatgtttggatctgctcctgcccctaagccttttgttacacttgcacctatttgaatcgtattgcgaacggcactactacgtaatacttgtgcatccgtattaaccgaaaagaattcaacactaccaacatcagattggttactaaccatatgatttagtgcgttaccaccaccgccaccgacaccgataactttgataaccgcatcttgcgttgcttcataaataggttcaaacatttgtgattctccctcacggcttaatattgttattaatgcctattaaaaacttgattttatccaattatacgcttttttagcactatgacctaatgtatcaataatgccgcccaccttatgactaatttctccactttggctactatcaacgtcattataatgactatactgtagcaatcctaatacggttgcataagacggtttgcttacataatccgttaatcctgtaatattcaatgggttaccaacccgaacttgtgatccaaagacagattttgcacattctacaatatcttctatttgagagccaccacctgtaagcacaattcctgcaattaattcttgttttatgcctttttgatatagttcattgcgtaattgggataattcctgattaattacgctcagtaaatcgtggtaacattgagatgtaacattagataattggctttttgtaaaagttcttggcattcgtccacccaagcctgctacctcaatttttttctcagggaaatgagttgggggtgcaatagcacatccatactgtactttaatattttctgcatcttggcgagaggttgtgaaaacatgagcaatatagtccgttacattattcccaccaaaaggaataactttactaaaacgcaaagcaccatctgtataaacaagaacatccatagtgccaccgccaatatcaattaaacaaaccccaagttctttttcatcttctgttaacacagaataacttgaagcaagccccgaaaaaacgatttgatcaatttttaatttacttctctccactgcattttttaaattacgtagccaatcgttatggcaagcaattaaatgagcttgagcctgcaaacgcataccagataaaccaaggggatttttagtagcaggtaatctatctactctatattcctgaggaataatgtgtaatgtttccagctcatcgggtaatttaatagaacgagcaatatgaatagcattatccaaatcttcatttcttacactaccagacaacggcacagttccactttcattaaaagctgtaatgtgagatcctgaaagggcaagagtaacacatacaatatcatatccagaaatcgattcagcttcttcaatcgcacgttgaatagcacttgttacagcatctaaatcaacaatgcctcctccttgaacgcctttagattgactaattccggaaccaatcacattaatcacaccatcaggcaatacttcacccaccacagcaactattttgtgtgtcccaatttctaaaccaactctaattctagattctgctacttttgtcatattatgtttgcggtattataaattattgattactaaatccgacggatgctccgtgttcataacgtaaatcgacataggataaacgttttccctcagggatgtcaatttcaggaaaaatagtcacaaaacgatcgatttttgatagccattcccctcgccctaattttagttcaacgccattatcaagtcgaattgaccaagctcctcgactatccattgcaatggaatgtaatcctaaattgcgtgattttaaatctgcttttattttatcccacgcttcaagcacaaccttactttctgcgtctggtccgtataaaataggtaagccagtgttatcaaaccgatctttcggtaaactaaaaacttttccttgaacagacacatattgattattattccatactgctgctgggcgatgttcaagtaacgtaatacttaatttatcgggataaacttttcttacagaaacatcacgaatccaagaaattgttagaaacttttctttaatctcttgaatatcctgttcaaaatagccttttaacaagggggctttagctaaaacttcgcgaatatcattattcgtcgtaaattgtgttttatgcgttaatgcataagaacgaattggagttctatccagtgatgcaagcaaactagaccaattggtatagattgcataagccataccgaaacataataacacaacgataggcttaacaaaaacaaaccaattaatcggatatttcggtttacttgcttgtgtacgaatcaccgaagtcggcttcttacgcattactgcaaccattacgcacttaactccaatacacgttcaactaaacgctcgaaactataacctacagtcgccgctgattttgggaaaatactatgactggtcatacctgggcaagtattcacttcaactaaacggaagtttccttcgccatcttccattacatcaattcggctccaaccacgacaacccactacatcataagcctgtttcactaacttagcgacttctgcttggcgatcagcatttaacgctggaacaacatactgggtattatccgaaatatattttgcgtggtagtcataaaactcgccgtctggaataatttgcactgcaggtaacacttcaccatcaagtactggcacagaatattccgctcctgctaaattttcttcgacaagtacaatttcatcatacttcaatgcttcttcaattgcaggcagtaactgttctgcggttttcactttactaacacccacacttgagccttcgctcgcaggtttcacaaataatggtaaacctaattttgcaataatttcatcggaattgaccgcttgtccacggcgaatgacttccattgccgctgttggtaagcccaccgcattccacaatagcttggtgcggaatttatctaaagtaatcgccgaagccattacgccacagcctgtatagggaatacctagttgctctaacgccccttgaagcacgccattttcaccgataccaccgtgaagaatattgaatacacgctgaatccctttttcttttaatttttcaatcggaaattcttttgtatcaatcgcttcaacgttatatcctaaactctgtaaggcttcaaagaccgatttacctgaattgagcgaaacttcacgttctgctgaaacgccaccaaataacaccgcaattttttcgttttttaagctcattattttttaccttatttatgttttacaagcggttatttatttcaagaattttacattattatggggaattgtagggacacactgcgtgtgtccgcaaaataaaccatatcccattttaacaacggacacacacagtgtgcccctacagttaattcattgaaattattgcaaattttcggatttaccgtagaggcgaattacattcaccctgatgttactatgattatttggggcaaatgtgatttgcccctacacattattttgtacaattacacaatagcgaaaatttctcgaaatcttaccgcttggttttaaagcttctttatgccttccaactttccgctaaatcacgcgaaagcttgctcacgttgcccgcaccttgtgccaaaattaaatcaccatcttgaataatttgatctaacacttcgccaagttgtgaagtatctgacactaaaatcggatccactttgccaagattacggattgaacggcagagatctttactctccgcaccaacaatcggagcttcgcctgccgcatacacattgagcataatcaacgcatcaacttgcgatagcacttgtacgaagtcatcaaataaatcacgggtacgagaataacggtgcggttggaaaaccatcactacacgtttattttcccaaccttgacgagcagctttaatcgtcacatccacttccgttgggtgatgaccgtagtcatcgactaacattaccttaccatttggacgaataaatgagccaagttggtcaaagcggcggcctgcaccttggaaatctgcaagggcagctaaaattgcttcattggcaatgccttcttctttcgcaaccgctaatgctgccgttgcgttcagtgcgttgtgtctacccggcacgtttagtaaaacttcgatacgctcgcctgtcggacaaaccaccgtataatgcccttggaaacctgtttgttgataatcttcaatacggtaatcggctttttcactaaaaccatagctaatcacttggcgaccaacttttggggcaatttccatcactgtttcatcatcagcacacatcactgctaaaccgtagaatggtaagttgcgtaagaaacgtacataggtttctttcattttctcgaaatcgccaccgtaagtatccatatgatctggttcaatgttggtcacaacagaaaccatcggctgtaaatgtaagaatgatgcatcactttcatcggcttctgcaattaagtaacggctcgcccctaaatgagcatttttacccgctgattttactaaaccaccatttacaaaagtaggatctaaccctgcttccgtataaatcattgaaatcattgcggttgtggtggttttaccgtgagtccctgcaatcgcaataccgtgacgaaaacgcataatttccgctaacatctgcgcacgttgaatcacaggaatacgagcttcttttgctgccgcgacttctgggttactgtcatcaatcgcactcgaagcgacaacaacacttgccccttcaatgttttctgcttgatgtccgataaaaatttttgcacctgcttttgctaagcgttgcgtgactgcaccgtccgcaatatccgagcctgaaatttggtaaccttcatttaataacacttcagcaatcccagacatacctgcgccaccgatcccaataaagtggatttgattcacacggcgcatttcagggactaattttttaactttatcttggaaatttttcattattacatttttccttcgtattcgtagggacacactgcgtgtgtccgtggataatttttagagtggacacacgcagtgtgtccctacaaggctcatttctgattacaaactattttccacaatcacttctaccactcgttttgcagctaatggtgtggctttcgctcttgcttttattgccatttccgtcagtttttgacggtcggcaattaacggttctaatgcttttaataaactttcaggggtaaaatcctgctgttcaataatcattgcggcacctgcttgtgcaaggtactctgcatttaaaaattgttggcgatctttatgttgaaacggcacaaaaatcgcaggtaatcctgctgcagcaatttcacatacagttaaagcaccagaacgacaaatcaccaaatccgcccattcataagcggctttcatatcgtcaataaattcactagcaatgccgttacctgtggcttgataaacttcttccacgccggctaatttgcctttaccgacttgatggctaataaatacgttttgtcctaagaccttcgctacttccggcacggttttattgatcaccaatgctccctgactaccgcccatcactaagatattgatcggatagcctttttcagcaaaacgttgttctggtggtacaatttcaaatagatcttggcgaacgggatttcccaccacttccgcatttggaaaagctgttggaaaggcttgtaaagtacggcgagcaattttagaaagccatacatttgttaaacctgccaccgcattttgttcgtgcaaaatcacaggcacaccacataattttgccgcaataccgcctggtccagacacataaccgcccattccaagtactgcatcaggcttatacgctttaataatttttttcgcttgaagcactgctcttaagatcgcaaaaggggcagtaagtaacgctttaatccccttgccctttaatcctgaaatttgaataaactcaatcggaataccgtgctttggcacaagatccgcttccattcgatcttttgttcctagccagcggatatcccaaccttgttgttgtaattctcttgctaccgcaatcgcaggaaaaacgtgcccaccagttccgccagccattaccaataatttttttgccatattattttccaacactaatcatcacttaaatgtgcgtgcccaattcgatctaagcggttttcgtaatcaatccgaattaataccgcaattgcaatcgccataatcactaaacttgaaccaccatagctcaccaatgggaaagttaagcctttggtcggcagtaaccccgaagcaacaccaaggtttacaaagccttgaataaaaatccaaatggcaataccaaaagcaaagaaacctttaaatcgttcttctagtattaacgcttcacgactgacttttaaagctctgaaagttaaggtgagtaataatagcacaacgataacaattccaactaatccaaattcttccgcaatgactgccatcacaaaatcggtatgtgcctcaggtaaatattctaatttttgcacagaattacccaatcctcgcccccaaatctcgccttgcccaaacgccatttgtgagttagatagttggaagccatcaccataagcatcagcaaaaggatccataaaagaggttatacgttttaaacgatattctgatgttaaaaccaatagagcaaagactacaacgcctgcgataccaagaaaaataaactgtaaaactttcgcccccataataaaaagcattgcaaatgtcagcacaaaaagcaccgctatacttcccaaatcaggttgagccagcaacaagcagctaaataaaatcaggattaccatagggcgaatgaaactaatgcttttttgtcgcatttcatcaaattttcttacatagaagctcgcaaaataacaaatcaccgcaaattttgctaattctgcaggctggaaattaataggaccgatagggatccagcgtgttgccccatttactgtttttccaacaaacaatgtaattgcaagcaaaagtagggctgaaataaataaccaaccattatacttttcccaatgtttacttggaatttgaacaaagaaagtacaagcacaaatagatgcgataacataaaaaccatctcgcaccgcaaaatagaaggggtcttcgtgtagccgactactcacaggaatagaggctgaagtcaccataacaaatccaatgatcagcaatgcgagaaataaccacaccaatgttcgatcatagagtgcattaacaggcgttaatcttgtccacttatcccactcaatccgaattttttctagcattagataaccccttgagccaacgccacaaactgtctgccacgctcttcaaaatttttaaactgatctaaactggcacaggctggtgaaagtagcaccatatcgcctgattttaatagtaaacgaacttgtgcgacagcttgtgtcattgtttccactaaaacgctattttgagttaaagcggcaagttccgccccatcttttccaaagcagtaacagactgtatttggctgattaataaaaggttttaactcagaaaaatcagcatctttcccatcgccacccaacaacagataaagcgttccttcgacttgtaaaccatttaatgcagccacagtactgccgacattcgtggcttttgagtcgttaatccagcgtacgccatcattcgtcggtactagctggaaacggtgatctaatcctgaatagctttgtagggctttcacaatccctgaacgagcaacaccagccgcttccgccaatgccattgaagccaaggcattcatcacattgtgacgacccgtgattttcagctcattaatcgcaataactgcttcatcgccagaatagagttcaccattacaagcggtatattctgcatctttttctgcaaattttttcaaagatctgaccgcttgtgtcggataagttagtggatcttcaccatttacaataatattttccgcattttgatagatacgcaattttgctgcacgatattcttcaacggagttattgtaacgatccatatgatcttcactaatgtttaaaatagtcgcagcttttgcttttaaagaataggtcgtttcaagctggaagcttgataattccaacacatagagttcgtaattgcttttcaataaactcaaggcaggcacgccgatgttaccgcccataccgactttgatacctgcttgttttgccatttccgttgtcaaagtcgttaccgtacttttaccatttgcccctgtaatcgcaataatcggtgcttttgcttcacggcagaacaactcaatatcgccaaccacttccacacctgcttgaatagcttgctgaatttctggcgttgctaaggcaagtcctgggctaatcacaattaaatcagaacttaataaccactcaaggtttaaactgcctgtatgcagtggaatatccctcgataatttatctaccccagcaggatttgcacgggtatcaatcactcgcacttgagcctgtttgtccgcaaaaaattcgacacaagataagcctgttgtgcctaagccgataatcgtgatggttttgccttgatattgattttgcattttgttgttctctagaaacggtattttcagatgtagggacacactgcgtgtgtccgctttattttcattattcctcgattggtaaaactgtaacggacacacgcagtgtgtccctacattaattaacgtaatttcaacgtcaccaatccaattaacaccaacattaaggtgataatccaaaaacgcacgataacacgtggttccggccagcctttaagttcaaagtggtggtggatcggtgccatacggaaaatacgtttttggcgaagtttgtacgatccaacttgtaaaatcaccgataaggcttcaaccacaaagacaccgcccatcaccactagtaataattcttggcgaactaatacggcaatcacccccaatgcaccgccaagtgacaatgaaccgacatcccccataaagacttgtgctgggtaagtgttaaaccataagaaacctaaacctgcccctgcaattgccgtacataaaatcactaattcactgctatatttgatataaggaatgtgcagatattgtgcaaaattatagttccccgttgcccacgcaattaatgcaaatgcccctgcgaccataatgatcggcacaattgccaagccatctaagccgtcggttaaattcactgcattactggttccgacaatcacaaaataggtgagaacaatatagaataagccaagctgtggcatcacatctttaaagaaaggaacaactaactgggtggcagcggtatctttaccaatcgcatacataccaaaagcagatgctaaggcaatcaccgatagccaaaaatatttccaacgagcaatcaagccatcggtatttttacgggctattttccaataatcatctacaaaaccgacaaccccatagccaaataggataaatagcacaaaccagacataggggttacgtagatccgcccataacaacgtactcacaccgatagcgaataaaatcataataccgcccatcgttggcgtgccccgttttttgtagtggctttcagggccatcgtggcgaacttcctgtccgaatttgagaatttgtaaacggcgaatgaccgtcgatccaatccataagccgataattaacgccgtcaataacgccataatggaacggaaagtaatgtacgacaccacgttaaacgctgtgttgtattgcaccagatattcagcaagccacactaacataagctaatccttaaaaagaaacatcaaaagaacgacataaggaagcaattacctcttccattttttggctacgagagccttttgccaaaagaacaagcggttggttttgctcgattttttgcaaaataatcggaagcaaaaacgccgccattgcggttttgtcattaaagtggtgagctgaattaccgctaatcacctcactctctttgccgaagctgaccactaaatcgagcttcgcctgtttaacgaaatcagcgacttcttggtgacaagctgggctgtctttgccaagttccgccatatcacccaccacaaaaatgcggaaagccggatactgttttaacactgataccgcagatttcattgagtccacattggcattgtaactgtcatcaataaacagtacattctctttaatttcaatcggatacaaacgccctttaaccgctgaacgctgttccaatccagctttaaccgcagttaaatccgcctcgactgccattgcgagtgctgttgccgctaacgcattactcacattatgttcgcctagataaggcaagttgatctcaatttcgccttgtggcgtatgtaaggtaaagcgtgaaccattgaggtgtaactcaacattttccgcccaaaaatctgcatagctgtctttatcttcgccggtgtagcagaacgactgtaactcgtgatcgccaatctctttctgccattctggatagtaatgagctaaattcacaatcgccttaccaccagccttcaagccacgataaatttcacctttagcttgagccacacctgccaacgagccaaatccttcaagatgagcagatgccacgttattcactaaacaggcatcaggttgtgcaatttcggtggtataagcaatttcgccgatgtggttcgcccccagttcaaccacggtaaatttatgctcaggggttaaacgtaataaggtcaatggtacacctaagtcattgtttaaattaccaaaggtataaagcacctgatcttcacaagcggtcactttttgcaaaatttttgcagtcatctctttgacggtggttttgcctgaagagcccgtaattgccacagtttttgggttaatttcagctttcagccattttgctaactgccctaatgccaagcgagtatcttccacaataatttgcggtacattcaccgccaattcacgctcaacgactaacgccacacagcgttgttctatcgctttttctacataatcgtgagcatcaaatttttcgccttttaaggcaaaaaataaacctttttcgaccgcttgacgggtgtctgtactgatgttttcaacaacaacctcgccactaccgagtagtttaccctttagggtttgagcgagttgttgggtggtttgttttatcatttattatcttctttattgtagggacacactgcgtgtgtccgttaaaaaatagctccacgaaagatggcggacacatgcagtatgtccctacgttctaccccaaaaacttcctcgcccactcttgatccgaaaagtgatatttcttcgtgccaataatttgataatcttcgtgtcctttaccagcaatcaaaatcacatcctttggctcggcttgggcgattgcttgttcaatcgcatattgacggatatgcatagactgcaccgctttttgtttgcggaaacctttcataacatcattaaaaatcacatcaggatcttcggtgcgtgggttgtcatcagtcacaatcactctgtccgccaactgttcggcaatacgagccattagcggacgcttacctgtatcacggtcgccaccgcaaccaaacacacaccatagttcgccttcacaatgcaaacgcgcggcatctaaggctttttctaaagcatcgggagtatgagcataatcaacaatcaccatcgggctttcttccgcattttcttcgctgattaaacactccatacgtccgcatacaccgtttaacagcggtgcggtttcgattaatttttgcaaatcgtagcccaaagccaataaaccagcgaaagcggttaataagttgctgacattaaacgccccgattaaacggcttttgagttcgccgttgccccagctactttcaaattcaatggttgcaccttgtagggtaaattgtacggctttgactttaatccaacgagattgttgtggctggaactggctatcagtgctaacggcgacagcttcaggcaattttgccaaccattcacgcccgatttcatcatcagcgttgatcacttgttgttttgatgaaagctcgccaaataagcgaaacttcgcttgggcgtactcttccattgtgttgtgataatcaaggtgatcacggcttaagttagtgaaaatcgccaagtcaaagtctagtgcttcggcacgatattgagccagcccgtgagaagagacttccattgcacagaaatccgctcctaattcgacaaagttcgcaagattgtgttgaatttcaacggcagagcctgtggtatttaccgcttcttgcacttgcccatatagtccgttgccaatagtacccatcaccgcagatttaccgccaagcaagtttcgccattgcgcaaaaagctgtgcggtagtggttttgccgttggtgcctgtaatacccacaagggttaatttttctgatggattgccatagaatgcaccagcaatcgctgaaagttgtttcggtaaatttggtacttccagtacacaagcggtcgaatttgcaaatttttctgcaaatctcaccgcttgaacatcgttgtccgcttcagctaaaactaaagaagccccttgttcaatcgctttttcaataaattgacgaccatcgacttgatgtccttttaaggcaacaaacagatcgcctttttcaacctgacggctgtccaaggtcattttatttaaagtttttaattctgcccagctttcaagtgccagaaaaaatgaaagtaaacgtttcatactataatcacttaatgagtttctgaaagattatccggtttaatgttatacgcttttagtgcatagcccataatactggagaataatggcgcagatactgcaccgccgtaataattgccagctttaggttcgttgatcaacaccactagtgcaaagcgtggattacttgcaggcgcaatacctgcagtgtaggcaaaatgttttttaacgtattgccctttttctaacttacggactgtacctgtttttaccgccacacggtagccatcaaccattgctcgttgtccgccttcgcctttttgcgcaacgctttccatcatcttcacgacatcgcgcgttatcttttccggtaatactcgatcgcctaacacaggcggatcgacttttgtaatagaaagaggtcgataaactccaaagctccctaaagttgcataagcgcgagctaattgcaatggtgttacatttaaaccataaccatatgccatcgttgcacgttcaatatccgcccaacgtttacgatcaccgtttgtaccacgttgctcgccaagccctaagcctgtatctttaccaaaaccgaccttgctataagtttcgactaatgcggttgatggcattcttaatgctaaacggcttaccccgatgttactggatttttgtaagatccctgtaagtgtcaaactctctcttggcgctacgtctttaattgtatgtccattaaccacaaaaggtcgtgtactaatgacttcacttggataagtcactctattttgtaatgcggttaaaaccacaagtggttttaccgttgaaccaggttcaaaggtatctgtaatcgcacggttacgtgctaattctgatttaaactctgctctgttatttgggttaaaggatggtgcatttgccattgccagcacttcacccgtttgaacatcaactaaaacagcagttcccgattccgccttgttttcaataacctcttttttgatttcacggtaaaccattgattgaagttcttcatcaatgctgagcatcacatcttgtggatcatattttttctcatcacgaatatgctcaatcacattgccacgagcatctttacgaatgacctgtttaccgtttttaccaaccaacaagctatcaaagctacgttctattccttccgagccttgtttatcatcaacatcggtaaagccgattaattgggaaatttcttctgcaagaggataaaaacggcgagtttctgcttttaatacaagcccatcaatttttaatgctcgagcataatctcctatcacatctgattcgtgacgagaaatatataaaaaacgttgatttgctgaagcataaagtttatccatcattacgctgtatttcatatctaatgctttggctaactcttgcattttttggtgttcaagctgagcatactcattttccaaatgtaaaaacatagaatttggattattgcgtatgcgttgaattaatacgttgtaatctaatgcagttgcacgagcgagtaatgtccaataatcctcatttttattgtttaaaatcgctctaggatcatatttattttctttattctgtggtttttctttaataaaacgattcacactagcttcaattttactggctgaagcctccatttccatagccaaaactcgccataacgatttattacgacgaagtttagtatcaaaatattctttaggatcaatcgtaattgaatacatcggcacactaattgaaagcactcgcccatttctatctaaaattttcccccttgtaaaaggaagctcttttgtccgtaaagagcgatcatttgcttctttgattaaacgttctgaatcagtgacttgtaagaaaaaactttgaccgatcaaggcacagaccattacaccgataaacagataaacaaatccaaatcgggcaggcaaaaaactaggctggggtgaaatatctacctcttttaattcatctcccatcgtatttttatttttagggttatatttcactgattttttcatttttattccactaaaatgatttcttgttcttttttaactggttgtaatccaaatttttcagcaacagcttcgactaaaaacttctgactttttgaattttcttctaattgcaaatgaacatactgattttcaagcttctgttttacttgcaataattttccctgctctgctgttaataaacgtgtttggtgcgtaatccaaatcgttgcaacagcactaatcaccaccccaacaagtagcaataacgccactttattatggctagttaaatcgtctaaaatcacttgacgtaaaggatagcgttcactcgacattatcttttctccgcaactcttaacaccgcactgcgtgagcgtggattggcttcaatctccgcttcacttggcataatcgctttgccgacggtttttaaaggaatattcttatttaactcactttctaaaatcggcagacctttcggcaccgtctcgcctttgctctgcttacgcataaactgcttcaccattctgtcttctagagaatggaagctgataatagacaaacgcccttcaggtgccagtacagttagggctgaatttaatgccttttctaattcatctaactcactattaatgtaaatacggattgcctgaaaagagcgagttgctgggtgtttatgcttatctttaaacggcacggcatctgcaataatttgtgccagttgcaaagtacgggaaattttttcagttgcagatttattgtaagaaacgaccgcttgtgcaatgcgtttggcaaaacgctcttcgccaaactcttttaacacccaagcaagatcatcaacagatacctgcgctaaccattccattgcagataagcctttggtggtatccattcgcatatctaatggtccatcacgcataaagctaaaaccacgttctgcttcgtcaagttgtggggaagatacgccaagatcgagtaagataccgtcaattttgccgactaaattaagttcgtcacaaatatcaggaatggatgaaaaagcactgtgaacaatttgaaaacggggatcagtgatcgtgttcgcttctgcaatcgcacgcggatcacgatcaatcgcaatcaatctaccctgttcacccaatttgcttaaaataagacgtgaatgcccaccacgcccaaaagtaccatcgacatagataccgttgggtttaatggctaaaccatcaactgcttcgtgtaataacaccgtaatatgtttgggtgagtcactcattttgattatccgttattgttataaagaaaggttctttaatgcctcacaatgaagcatttcttctgagctaccaattgcaagatcttcgctaatctgtttctgccattgttgatcttgccaaatttcaaatttatttaactgcccaaccaacataatctgctgttctaattgagcgtgctgacgcaaagtcgggctaagtaaaatccgtccagcagaatccatttcacattctgtcgcaaaaccttgcataacccgttgaatacgacgctgtgcaggatcgaagttagacagagcgagcaatttttgctcgataatttcccattcgtgcaacggatacaataataaacaaggctggcgaatatctacggtacaaacaaatgacccgtggtaactctccaaaagctcggcacgataacgggtcggaatagcgatccgccctttgctatcaatgctgattgaagttgctccacgaaacatttttttgctcacttaaccttagagattcggaaatttggaaaaaattccacaaaacaccactttttcccactttaattgaagaattttatagttttcgtagattaggggcaagaaatttgtcagaaaaatacgaatatatttaattataaatagaattcattacccgcagcaaaaacaacaaactactttacattgcctcaaaatcaagcaaacgaaaacatttgtaattgttgtaaaacacagtacatttacttgtaaacgtttttacaataggagagctttttaagcttatttacatgaaaaacagagttcggtggaatcatcaatttagacaaagttcgttctgacaaagtatatagcttaaatttaacgctatggaagcgcaattggtattggttaggagtaacacctagggctacaatttacctatcgtaagcaaaatagtaatttgccaacgctctatttctgtacggataaaaacgtcaatatcttagttgaaagccagttttaaattgtagggatagggactatccgcttcgatctctatttccttgcctttgaccaatctaacgaggaaacaagcgaaaatcccctcttacataacttttcttaaaattagctgttgtgcagctgctacacaacaccagataaaatcttatttaaaacaaattgatctcgtcgccctattcctttattccctaactttctctataatcctaatcctcttatgttctttaaaatctggtggaattatgaacccaatgttaaatatcgctattcgtgcagcacgaaaagcaggcaatattattgctaaaggctatgagcaagcgcctcaagacactcaagttgctcaaaaaggcgcaaatgactatgttaccgaaattgataaagcagcagaagcagccattattgaagtgatccgtaaatcgtatcctgatcatgctattgttggcgaagaatcaggcgttttagctggcacaaataacgatgtacaatgggtgattgatccattagatggcacaacaaactttgttaaacgcttgccacattttgcggtgtcgattgctattcgtgtgaatggtcgtactgaggtgggtgttgtatatgatcctattcgtaacgaattatttaccgctgtgcgtggcgaaggtacaaaattaaatgaattccgccttcgcattagtaatgaacgtcgtgatttacaaggcacagtgttagcaacaggtttcccgtttaaagtcgcaaaacatcgtactgctcacttaaatatgattgaagccttgatgaacaatggcgtagcagatttccgccgtactggttctgcagcattagatttagcttatgtggctgctggtcgtgttgatggttactttgaaatcggattaaaaccgtgggattgtgctgcaggcgatttaattgcccgtgaatcaggtgcgttagtgaccaactttgttggtggtacagattacttaaaatcaggtaatgtagtggcaggtagcggtcgtgttgtaaaagaaattttaaacagtattcaaccgaccttaactgaagaactcaaagcctaataatagattttttttgatgggcagttgcccacccaacgattaaagataagcttatgcaaaagacctatccattgctcagtcaaatcaactcgcctgatgatttgcgtttattaccaaaagataaacttcaacctctttgtgatgaactgcgtgcctatttgttagagtccgtcagtcaaacaagcggtcacttagcctctggattaggcgtggtcgaattgaccgttgccttgcattatgtttatcagaccccattcgatcaacttatctgggacgtaggacaccaagcctatccacataaaattttaacgggtcgccgtgaccaaatgcatactattcgtcaaaaagacggcttacacccattcccttggcgtgaagaaagtccttttgatgtattgagcgttggacactcttctacctccattagtgctggtttaggcattgccgttgccgcagaaaaagagaacgctgggcgtaaaacggtctgtgtgattggtgatggtgcaatcactgcaggtatggcatttgaagcgattaaccacgcaggttcaattcataccgatatgttggttatcttaaatgacaacgaaatgtccatctcagaaaatgtgggagcattaaataatcacttagctcgccttttcactggttcgctttatggtactttacgtgaagggggcaaaaaactgctctcaggcattccgtcgatcaaagagtttgtgcgaaaaacagaagaacacgttaagggctttgtttcgcctgttggcacaatgtttgaaacccttggctttaactatatcggcccgattgacggacacgatattgaagaactgatttctaccctgaaaaatatgcgaaatatgtcaggaccacagttcttacatattaaaaccaaaaaaggcaaaggttatactccagcggaacaagaccctatcggtttccacggtgtgccgaaatttgaccatacaagcggtaagttaccacaaaccaaatccgtaccgacctattccaacatttttggcgactggctttgcgaaatggcagagcgtgatccgaagattatcggcattacccctgcaatgcgtgaaggatcgggaatggttgagttttctaaacgctttccacaacaatactttgatgtggcgattgccgaacagcacgccgtgacctttggggcagggcttgcgattgcaggttacaagcctgtggtagcgatttactctagcttcctacaacgtgcttatgaccaacttattcacgatgtggctattcaaaacttgcctgtcatttttgcaattgaccgtgctggtattgtgggagcagacgggcagacccatcaaggcgcatttgatttaagttttatgcgttgtgtcccaaatatgacgataatgtgtccaagtgatgaaaatgaaatgcgtcaaatgctttacactgcttacacaatgaacagccctgttgccgtgcgttatccgcgtggcaatgcacaaggcgttgagcttcaaccgatgcaagcccttgaaatcggcaaaggcaaagtgttaaaacagggggaaaaggtcgctattctcaatttcggggcattattaaacgaagccaaacaagtggcagaagcccataattacaccctcgttgatatgcgttttgcaaaaccgctagatgaagccttaattgcagagcttgtcgaccgccacgaattattagtcacccttgaagaaaatgcccttcaaggtggggctggcagtgcggtaaatgaatacttgcaacatatcggcaaaatcaaaccgctattgatgttgggcattcctgatttctttatccaacaagctacgcaagccgaatcctatgcggatttagggttagatgcgaaagggattgagcagaagattctatctatgaaatgagttaatttccaaatctcattaaaaagctaagatactaaacctaagttgcccattcttaggcatggcagacaaatgggcacagtagacaaactagttactaatgtttattttttctaaatattagcagcaaatttgtctattatccccattcttatgccataaatctatcttccacaatatcactattaggagatattacttcagctgctcttcaataatcccaccgcccaaacagacttcgccttgataaaatacggcggactgtcctggggtaacggcgatttgaggttcatcaaaaatcactcgaatggtttcgtcatcaagcggttggatttcacataaaatatccgcttggcggtagcgtgtttttactgtgcaacgtagtttttcacggatcggttggcgatctacccagtgaagttggcttgcaatcaggccgcttgaaagcaacgcagaattatcctgaccttgagcgacaattagcacattattcaccagatctttttccactacataccacgcattttcactcgcccctttgacaccaccaatacctaaacctttgcgttgtcctaaggtgtggtacattaagccatcgtgacgaccaatcacttgcccatcgacggttttaatatccccagcttgtgcaggtaaataacgagcaaggaaatctttgaatttacgttcgccgataaaacagatccccgtcgaatcttttttctttgctgtcgctaaacctaggtcttctgcaatagctcggacaatcggtttttcaatatcaccaacagggaaaagactttgtgcaacttgttgctcgctcagagtgtagaggaaataactttgatctttgttgctatcaagtccacgcaataattttgggtgttgatcaagcggtggacgacggacataatgccctgtggcaataaaatccgcccctaaatcctctgcagcatattctaaaaaggctttgaatttgatctctttgttacacaaaatatcagggtttggtgtgcgtcctgctttatattcggcaaggaaatgctcaaacacattatcccagtactctgcggcaaaattgattttatgcagtttaatacccagcttatcgcaaacggcttgtgcatcggctaaatctgccgctgctgtgcagtaatccgtgtcatcgtcttcttcccagttcttcataaacaagccttccacttggtagccttgttgttgaagaataaaggctgaaaccgaagaatctacgcctcccgacattccgcagatcacttttttctttgcattttccgctaattgttcatcggtaagtgcaggaaaatgttgttggtaagtttttgatttcattattgttgttctgtccgttgataaaattgctgtcccactctgtcgatatgctgaataaaattttcgtgagccagttcgtgataaattgaaagatcaaacagataaggtaggctagagtcttctaaatctagcctgattttacccaatatgctctgattaagatttggtcctttaaaagttaagtcaacatcagaacctatccgataattaccctttgctcgagaaccataaataatcgcctgctcaatttcggggtatttcttgagaatatcagtaattaccctaatagattgttcatttaatccaaacttttctgccataattccatcattctcttttctaatgcaaggaaaaggggaagataaatgtgaacaattttttcaaattctttcaacaaaatttgagcatcataagtatgaactgtcatattacggctattcaacatttccatccaatgatgcccctcaaaaataagctcatattgaaaggctattcgagttacgtttctaggtccatttgcatctaaaagaccttgatatttcaaatagtcttgcattactttccaagcaagttcgtgagcgatttcaaaactttgaataatcccttttttgataatatcaagatcagtatctgcatacttttctacatcatcttttagataagcaacagcatgttgataattttcaaaacgctgtttccagcgaatatcttgttgctccatttttccttcctattgatgaaaaaattattttacttcgtaaaactgagcctctttcttggcaaatttttcttcatattcggctttagcagcttcatcgcctgcttctaattttgcttttaaattatcacaaggctcatcgcagtcacagacttttttcattcctaatgcagaaataccgccacaactacctttaattgttttacctttgataataaagccgattgacatcataaatacaatggctacaaagaaagcaaaggtcagtaaaattgtttccattttttatcctattatttttgattaattaatttttcaaaggcactcgacattttagtttcatatccgtcgcctttcttgataattaagaaaattgctaaattttcacgttctgccacttccagtgctttttctgctcctaacacatataagcctgttgaaagtccatctgcagtcattgtggttggtgcaaatacagtaattgaggctaagttatggctaatcggacgtaatgcttttggatcgataatgtgagataggcgattaccctgttcatcttcaaaatagttgcggtaattacccgaagtcgccatacctaaattatgcaatggcacaacaatttgacttgatgttccttgagcaaattcaggtttttcaactgcaatacgccacggttgcccttttaaatttagcccttttccgcgtaattcaccgccgatctcaacaaggtaatgttgtacccctaattgctcaaggtaatccgctaatttatctacgccaaatcctttggcaattgctgaaagatcgagataaagctctggtactttttttgttaatgtggcttttgtggcgttatcatctaagactaatttttcaataccaacccaagtggcacgttctgcaatttgttcttccgttggtgctttatttaggcgtttatctggtccaaatccccataaattaaccaaaggcccaacggtcacatctaacgcaccttctgtcactttatttagacgtaccgcttctttgaccactttggcaaaatcagaggcaatttcaaacggtttatctgcctctttcatttgattaaattggctaatttgagagtctttttgataggtggacatctcgttatttaccatttttaacaacgtatccatttgacgttgaacctcttctggtttaggtaaatttgttaagctaccatcatcaatatatttgatatggtaggttgttcccattgttttaccttcaaaggcaatttgttggggttctttattacaagcagaaagcattacagcgaaaaatgccgaaattgcccacattagtgacgttttgattttcatacttcctcccaaaacgaataattaaattaataatggaaaatagataagggcgatttccttatctattttccattattggattgtgttaataccctacatagaattatagcataatctattaggttcagtatgtggaaaatgctccatttgtaaaacacaatagattttttatgatataaaatttactatttagcagttttattcaccaaaatttttcggtaagttttttaacatttcagcccaaatttcggtactacgttgactgctcattgctaaacattctacggctttttcgtaatcattagtttcacaagcggtacgaagtgcttggtaaaatgcaaaacttaattggcgagaactaggattagagaaaaataaagatgccgtttttaaatagagatctttaaaactatttaaaatcaacccataaacaggcttattggcaataaaagtaaattcacgatatagcttatagtcaaattcagcataagcttgtgccgtattttgaagtaattcaagatcttttaagagtaatgaagaagctaaatgatcagctttaattgcctcaggaataaagtattcccccattctagtacgcaatgaaacaacatttgaaataatcgttggtgtaatagattcatctaaatgaattaatgtactaatgatatttggacctgctgtttcccaaatattatttactcgagttggcttaccgtgttgaatactcaaccaaccatcacgcgcaagacgctgtaaaacttctcttaacgttgtacgcgtaacaccaataatgtctgcaagctcacgttctgcaggtaaatctgaaccagctggaaagcggttactccaaatacttttgattaaatactcttcagcaagggctgctgggctttgggctcttaaaatgtctgattgattcattgatttatctcaaaaaatgaagaaatacttcaaataaatagtaaaaagtgtgatgtactcatcaaaaatgatattgccttccatataatggctcttggggtattatcgtttaatctaaactagattacaatccacaatcatttttactttttaattaaatctatgaataatcttgacgctttttataaaaactttctcggtaacgcaccagaatggtataaggcttgtattattgccttcttaattatcaatccattgctctattttttcattagtccatttgttgctggttgggcattagtggctgaatttatttttacgttagcaatggcattaaaatgttatcctctacaaccaggtggtctacttgccattgaagctgtcgctattggaatgacgagcgctgagcatatcaaaaaagaaattctcgccaactttgaagtcgttttattgttgatctttatggtggcaggtatttactttatgaaacgcttgttactttatgcattcactaagctactgatttccatccattctaaaaaaatgcttgcactcactttctgtttaagtgcggcattcttatctgcattcctcgatgctttaacggtaattgcggtgattattagtgttggaatgggattctataaagtttaccataaggtcgcatcaggtgggcttttggacgatgatgagtccgatgatgcttcaaatgataaattaattacaaacaaacaaattttagaacaatttcgtggtttcttgcgtagcttattaatgcacgctggagtaggtagtgcgttaggtggcgtgatgacaatggtcggtgaaccgcaaaatttaattattgctgctcaagctgattggggatttggggaatttttcttacgggtagctccaattagtatcattgtgcttgtatcaggtattgcaacctgttatctcgtagaaaaatacaaactttttggttatggtgaccgcttgccgcgtaaagtttgggtggtattagcccattataacttgcgtaaagaacaagagatgacaaaacgagaccgaatgaaattggttattcaagccatagcaggtgtttggttagtcattgcgttggcattgcatttagcggaagtaggattaatcggtctctctgttattattttctgtacagctttctgtggtatcactgatgaacacgccttaggacgttctttccaagagtcgctaccatttaccgcattgcttgtggctttcttctctatcgttgccgtgattgtagatttgaaactctttgatccaattactcaatttgttctgtccgctgaaccaagctcacaattggtgctgttctatacatttaatggattgctttcaatgatttcggataacgttttcgttggaaccgtttacattaacgaagcaaaagcagctttccaagctggcattattagtagggaacaatttgacctgattgctgtcgcaattaacacaggaaccaatttaccatcagttgctactccaaatggacaagctgcatttttattcttattgacctctgctattgcaccattaattcgtttatcctatggacgaatggtctatatggcattaccatataccgtagttttatcaggagtagggttctttgcattagaatttttactgccacaattaacaaaattaatgacggagtggggctggttaatcactcgttaaaaataaagggaaccgtatgctaacttattttaaagagctatcaataagccgtagtgcttggctacttctcactgcaagctgtacagcactagaagctgctgcgctctattttcaacacggaatgggactaaacccttgcgtgatgtgtatttatgaacgattagctctattggcgattttaattgcggggattatcggctttttagccccccgcaaaacgctcgtacgttggcttgcattattacttggtttatttggctcaataaaaggtttaagccttgcaattaagcatacggattatcagctcaatcctgctccgtggaaccagtgttcaccttttgtagatttccctgaaacattgccattgaacaaatggttcccagatctctttgaagctacaggtaaaggcgattgtggaaaagtggtctggcaatttttagatctctctatgccacaatggttgattgtggttttctctatttatattgtcgtttttgctgttattattataagtcaattcaagcaaacttcttcatacagaacattatttcgttaggtgaaatatgagtagcgaatctaaatctttttttcgtacattattagagaaatacaacgagttatgtaaagatcttgacgttgaccaaggtgcttgtcgaggctgtgtacccattgtaaaatttgatcccgaacaagatgataaatctggagaaaaaacaaaagatgtttaaattatcttaaatgggatagagaaaaatctatcccatttatccgttctaaacatgtcatactatgatgtccccccccattcatttctaaaagaatgatttaactctcgcaattttattcataatctctataccatttgaaaatttttatttggagtctttatgtcatctactcaacaattccaaacgctgtttgaacagtcgttgaaaaactactgtgaagagcgttttttaaaacctgaacaactttctacacaacaatggtatcaattcattgccgaagtcagccaacaggcgattttgcaaaatttttctaaaaacgcaccgcttgtaaacactcgcaaagtaaactatctctcaatggagttcttaatcggacgtttactgggtaacaacttaatgagtctgggcgtttatcaatatgtgcatttagcccttgctcaatatggtaaaaatttagtcgatattctcgaagaagaacgtgatccatcgttaggtaacggcggtttaggtcgtttggctgcctgttatttagattcaatggcaagccttgctcagccagcagtgggatacggattacactatcaatacggcttattcaaacagagctttggctgggcaggtgaacaacgtgaagaaggcgatgcgtggagccgtgatttctacgctcaacaatatcatcgcccagattttcgtcaaaccgttggctttggtggcgaagtatggcatcgtgacggtgataaatatgaatggaaaccagcgtggacaatttatggtaaagcctttgatttacctgtagtgggttataaaggggttcaacagccgttgcgtttatggcaaggttatagcgaaacgtccttcgatcttgatcaatttaacgacggcgactatcttgagtctgaaagcaaagtggttgatgcgtcaaaattaaccaaagtgctatatccaaacgacaatcatcaagaaggtaaagagttgcgtttaatgcaacaatatttccactgtgcttgctctgttgccgatattctaaaaaatcaccttgcacaaggcagaaccttagagcagttgcctgaatttgaagtgatccagttaaacgatacacaccctgcgattgcaattcctgaattaatgcgtcttttgattgacgaatacggtttatgttgggatcgagcttgggcaatttgttcaaaaacatttgcttacaccaaccatactttattgcctgaagcgttggagcagtgggatcaaaatctcgtcgcgaaattgttgccacgccatttaatcatcattgaccgcattaaccacgagctttatcaacaagtgaaagcggaatttagcgaagcagaatttgcagatgcgtgggacgaaacagcggtcttaatgaaccaccgtgtgcgtatggcaaacctttgtgttgtaggatcttttgctgtcaatggtgtggcacaaattcactcggatttagtggtaagcgatttattcccagcttataaccgcttgtttaaaggtcgcttccataatgtaactaacggtattacccctcgtcgttggatccgccaagcaaacccattactaagtgcgttgttagataaatatatcaaaggtgactggacgaaagatcttgaattgttggctcaaattgagaaatttgccaaagatccacagttccaagcagattacaatcacatcaaacagcaaaacaaacagctattagcgaaagaaattgagcaatcacttggtttaaaagtgaattgcaatgcgattttcgatgttcaaattaaacgtttccacgaatacaaacgccaacatttgaacctgttgaatatcatcgccacttatcaagagcttaaagagaacccacaacaagaggttgtaccacgcctgtttatctttgcaggtaaagcggcaccaggttactttatggcgaaacaaattattcaagccatcaacgctgtggcaaaagtgattaacaacgatcctgatatgcaaggtaaattacaagtagcattcttaccagactaccgtgtaagccttgcggagaaaatcattcctgcggcagatgtttctgagcagatttctcttgcgggtaaagaagcgtcaggtacgggcaatatgaaattagctctcaatggtgcaattacgcttggcacattagacggtgcaaacgtagaaattgcagaatttgcaggggaagaaaatgtcgtgattttcggacataccgttgaatctgtgcgtgaattgcgtgcaaaaggttatgtgtctaaaacgtactatgagcaagatcctgtattaaaacgagcaattgatgccttagcggacggcacattctcaggtggtaataaagatacctttgaaccattagtttatgatctgttaaacaaagattatttctgtgtgttagcagattttgcaagctaccgtgaagctcaaaaagaagtcgcaaaacgttatcaagatcaaaccgcttgggttgaatctgcgattcttaatacggctcgtttgggtatgtttagctcagaccgttcgattcgtgattatcagacacggatttggaagaaatagagatatggtagctaaaaatgatttttgtcatttttagctactattttgtctattacacctatttttttatatgctgctaatactggtgcgagctagatactcgcaccaattaatttagatattcttagaatttataacttactgttgcatttactttacgttcagcgccgtaatagcagtagtaatcgcatgccgcaacatatttacgattgcctacgttatccacattaagttgtgcgctccagttttggttgatttggtaacgagccattaaatcgactaacgtcacagacggtaaacgtgcatgtgagtaaagtgaaccttttgacgttacgctaatgctctacataacgaatacctgcacctacggttaagccgtttaacataccattgctaaacgtataagctgtttttgctgcaagggtatttgttggaattaacgggcggcgtgttttggttccggttgagtccttgctttctgcttttgtgtaagtgtaagctaaggttccagtccaattttcggttaagtttacatctgcttgaagctcgaagcctttacggtaaattggatcttcatcactctctgttgaaacagtgccattaggttgtaatttacttactaaagcatcggtatccttcgctcggaagcctgcgatagtaattaccccatctagccacattgagctggttaaaatgcttaagcgagtacgatctgaaatatcccattctaaggttggtgcaaggtagatcgttttattttcggtatctttccattcgccattggcgtgatttaatgaggcgacaatgcgataacgtacgctttcatcatcggtcatttttcctgtgtaatctgcgccaaaaccatacaagctatttgtaccaaaattcgttttgaattcgcctttaccggtttgatcacggtgtgcacgtttggtcacatagttaattaaaccgcctgattgtgctgcaccaaaggtcattgagtctgcaccttttgttacttcaacagcttctaagccaaaactttctacataaggcgtaaagaagccataactgaaggtcggcaagccgtttactgcttgtgaaacttcagctccacgcacacggaaccagtttgtgttagtatcgttaccaaatacttgattcgcaaaacctgcttggtagcgaccgatttcatcgacttttttcacgtcttgtttatctagttcatcacgagaaatggctatcgctgattttgcttggtgtacaggtacttcacccattttatacatcgagccaccactaacaaccgcaacttcatctaacgctgcaacatcatttttgcagactcatttgccattgcattgcttgcaatggcaagtagtactacttgagaaattgttgaataaacaaatgttttttcggtattatgtatcagctacgtaaatatctcagcccttttgaaccgagggctgagagtaatttgttgtctgaatataaatacaaagttaaccccgatgaaaaccgctcaactttaccgttattccttacctgttgaaacaggcattatcttacgtaaccgccgtttaaaacaacgagatggtttgattattcatttgaaacatgctgacaaagaaggctggggggaaatcgccccattgcctgaatttagccaagaaaccttagcagaggcggaaattgcagttcgccaatggattgaaaagtggctaaatcatcaagacgattctttaacatcctatccaccgtccgttgcatttggggtcagcagtgccttagcagaactcaatgaaacattaagcgaagaagccaactttcaaactgtgccactctgttatggcgacccagatgaactttatgcagaattgaaccaaatgcaaggggaaaaaatcgccaaaattaaagtagggttatatgaagctaatcgagatgggcttattgcggatatgtttttagaagcgattcccgatttaaaattgcggcttgatgctaatcgctcatggacgctagaaaaggcgttgctttttgcaagtaaaattgcccctgaacgcaaaaagcgcattcagtttttagaggaaccctgcaaaactccagaactttcacgtcagtttgctgaacagacagggataaatatcgcttgggatgaaacagtacgagagcctgattttttggtaaaaaaagagccaaatctaaccgctattgtgattaagccaacgctcgttggttcccttgaaaaatgtatttcactcattgaacaggctcatcagcaaggtttaattgctgtgataagttcaagtattgaatctagtcttgggcttactcaactggctcgctttgcgactcaatatactccaaacactttggctggtttagatactttagatttaatgaaagtacagttattgcgggagtggaataattcaactttaccgatagtgcatttaaatagcccgtatattttgggattagacgacaatgttaagtaggctatgtgataatgattaaatagcagcctgttcaagagacgatgcggtgtaaaatatcccatctaaatcaccgctttcatcagatttcccgcctattatttctaacttttttaataattgacaataaaagttgaaaaatgcttgttattttattctttattttatgtaaatgttgtttttttttttttttttttacaatggagtggggacatctgtacaccctgaaaatgtaaataaaagtttatgatgctttattaggaaaagcgttagagaaagttattatggaaagttattatgaataaaatatttagagttatttggagtcatgctcaacaggcttgggttgttgtatctgaattagtaaaatctcataccaaaacatccacttacacggataaaagagctcaagtatgcacctcacattattttttagataaacagcaagataaatttaaattaagttttttaagtctagtattattaagtatattttttagtccagtaggttcagctgcagaatggtttcaaaatggttctagtgcagggtttcgaggatataacggcgattctattggtattggtagagatagtaaggttgggcctggttctattactattggtgctcaatcaaaagctgaaagtacgactgctgttgcgataggttttgacgctcgagcattagctaacaattccacagccgttggagcaagaacaatagcagacttttattctgcggcttatggtcatcgagcaagagcactaggaacacactctgttgcagtcggtgaagaagctgttacaaatcaaaatattaatagagccactgcattgggtagcaattcacttgttatcgttggcggtggtgttgcattgggttatggttcaagagcagaaacggcaggtgatattgaaggggcaaaacagtcttattctgtaacagcagcaagcagtgttgataacggctttaaatccacaggaagtgttgacaacaatcctattggtgcagtttctgtgggtaatgacagaatcaaacgccaaattactaatgttgccgcaggtaaagtagatactgacgcagtaaacgtggcacagcttaaatcgcttacaatgcaaacaggaggcgataacggcagcagtggcaaggtaggcatttggaatggcaaacttgaagttaaaggcacaagtggcgaaatcaagaccaatgcgtctaactcaaccatcacaataggtttagaacaagacgttaagactaaactggctcagattgccgataaaatgtcgtcttttaagattaaaacaagtacggataacaatgaagctacaattacgaatggaaatacaatccagtttactgcaggagataatattaaattagaacaaacgaacggaaatattaagatttctacgattggtaagttaattacaaagactgaaatggtaaatggtggtttgaaaattacttatacggatggcaccagtgatactattactaatgggaaagacggtagagatggtgcgaaaggtgaaccaggtattccaggacctaagggtccagtagggcctaggggtgaaccgggtccaaaaggtgatatgggtccagagggaccacgaggccctgcgggtccaaccggtgctcaaggtccagcaggacctaggggtgaacagggtcttaaaggtgagcaaggcccagctggaccaaaaggcgaagctggtccaacaggtccgattggtccagtgggtccgaaaggtgaaaaaggagatcaaggtccggtgggtccggcaggcccagcgggtgctcagggcatacaaggtcctaaaggagatgcaggtccaaaaggtgatacaggtcttagaggtgaaactggccctgcgggtccagcaggaccacgaggacctgtgggtccaacgggaccgcaaggaatgccaggtattcagggacagaagggtgagcgaggagaaacaggtccagcgggtccagcaggggctaagggcgatagaggcgaaccaggacaggcgggtccagaaggaccacgaggaccgcagggaacagcgggtgctcagggacctaagggggataaaggcgatccaggacaagcgggtccagcaggaccacgaggacctgtgggtccaacgggaccgcaaggaatgccaggtattcagggacagaagggtgagcgaggagaaacaggtccagcgggtccagcgggacctaagggtgaaccgggtcctaaaggtgaacaaggtattccaggacctacgggtccaacgggatcacaagaccctgcgggtccaactggaaattcggaattaaaaggcattacgtcgatagccaatggtaacgacgccaccaaggagaatggggctaagattaccttgtctgcaggttctacagataaaacagttaatgttaatgatgcgaaaattaccaatgtggcggctggtacagcagatactgatgcggtgaatgtgagccagttaaatactaaggcagcagcttcaaaaacagaggttaaatcaacggacaaatcggttggcgttacagcaagtaaaggtgacaaagatcaaacgatttatgatttatcggtggtgaaatctaaattgaaggctgctgaggataaacgtacagttacggctgaaaccaagggcaatgcttttgtaacaggtgaggaagtggcgaatgccatcaacaccacaaccgcagcggcgagaactgaggttgaagcgggtaaaaatgtgaaagtcacttcaaaaacgggtgcaaatgatcagaatatttacaaggtgagcgtgtctggagatttaagcgacattacttcaattagtaatggcgatacgaaagtatctttaggtaaagatgagcaaggaaatccagttgtaaatatgaatggtgccagaattaccaacattggagatggtagtactgagggcgatgttgtgaatgttcgtcagctcaacacagtggtttcttcgatgaatgctggatttaatcaattgtcgaaagatattagtcgtgttgatgtcaatgcaagagcaggtattgcatctgctggggcaatggcgaatttacctcaagtaaatttaccaggtaaaagtgcgatttccgtttctggtgcacaatatcgtggacaagcagcttatgcaattggctactcaaaaatttctgataatggcaaatggggtattcgagcgtctgttagcagtaatactcagcgggatactatgattggaggaggggcaagttttgtgtggtaatctagcacctataaattagaatttcatgctcaatgccattgttattttaacaatggcattgttttctatagtgggtttagtggtaggtttgaataaatttttgataggcattcaaaaacatttcaaaatcttctaatccgcaaaaagcgatactttcttcatcatagaaactaaagccgttttcgacatcttcgatttcttcaaatgtcatatccagattatttgctttcaccatcacttcttcaatgttgatataaaggctatattctttaccttcaaaaatccattcgtagttttgatctttggtttggcgacaatgctcaatttcagcaaaaatagcggttaactcttttggatttggcacaatctcggtatttaaccaacgagcaaatgcctcgtgatccattgaacatttggcaataacgccgtgcatggtatgtgtaaattggtattccatcattttctcctttcaaacaagcggtcggattcgtttggttttttgcaaaatattataacgaagtgaccgcttgcaactacaacttaacctttcttcaaaatctcttttaaaaatcttgccgtatgggatttcttatcttttgccacctcttcaggcgtaccttcggcgataatctgtccgccacgcacgttaaagctgaaacgtccgacagtatagccccttgctcttgcttcttgtgtaccagcaaagagttcacggatcggggtaaataaacctgtgtaagtcgcagggtttgaacgtggcgtacgtccaatcgggctttgattgatgtcgatcactttgtcgaaatgagccaatccgtcaatgttcttatagataccataagacacaacaaattttatttcataaatgtgtctaaattaaatgctgtttgtttttgcaaaacagcctgtgcaatagtgactaatttacgcattaaagccgtgataatcaccattttaggtttgccgcattcaagcaatcgcagcacaaacgagcgatatacgctgtttttgtagctgccaaaggcaaagttcattgcagggcaaaagagtgccttacgaatgtcggattgcccgatttttgaaataccaataacggtatttaaactttttcccgaacttttaatcatcggggttaaacctgcaaaagtggcggctgctttcgcgtttttaaaacgattgccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggcaatcatctgctgtgttgaagcaatgcaatcgctgtcaagcaacatcgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgcactgcatttagggttaatcacgctaacggtgatttgctgttggaacagaaaatctgccaaagcttcgtgataaatattggtggcttcgatcacgcagtgaaaagtttcaccaaatgtattgagccattgcataagtgattgaaatccttccggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcaaagcaactctactttctctataaccccattatgaaggtactcgtaatggggttttcttttgcccatattctaatacaaggggcaaatatgattttcccctacaaaaatagattgcagactttgtatagtggctatctaatgtcaaaataattaagcccttcttagcatcagcaagaaataagtccccccaatcagcgttgccactaaaccggccggcacttcataagggaataacatctgtctgccgagccagtcggcaaataccataatcacactaccaagaagggcagagattaaaatctgggaactcgctcggtttacgccgagaaaacgggcgatatgtgggacgagcaagccgataaaactgagcggtccgataatcaatgtcgctaacaccgtcagtaatgcggtaaataaaatcaaaatccaacgagtgcgtttgaggtttaaccctaaggcttgtgccatcggagcttgtagtgccagtaattcaagccaacggctgaaaatcaggctaatccccaatagaacaaggcttacaaagaaaaacggcacggcaagatccgccccgatttgttggattgaacccgatgtccacgcaatcagttggttcgctcttgggtcgccactggcaatggctatgcgttgcaaagtgtcaaacagtgccgataagctgatccctgccaaccaataccattctgtttgggttgagcgttaagcgttgcaataacacgccagccaccgctaataagatcccaacagaaagtgcggtcaaaattcgaggataacgtagctccacaagtggtgcgaaaaagtcgttaaattccaataaaatccaaccgtttgtgcctttgcccagagcaagtgcaagccatagcacgagtgcaaaaacaagtacaatcggcagtaaagtgtaacgatgaaaacggcgagatagacgagttgatgtttccgtcaaacgccctgtatttgacagcgagcggaacatcagccacagtagtaatggcgtgccaagcagagccgttactgcccccgtcggcaagttaattcctttaaaatgagcaagcagttggagcaataaatccgtcacggcaagcaataacgctccgaccgcaaatgcaccgagcagctgcccttttagtgttcgtacaccaagttggcggataatggtggcggacgctagcccgataaaaccgagcataccgacacaactgaccaccgccgaaatcatataagcactgataaacaccccgaaaaaacgcaggcgattaaccggcacaccaaggctttgggcattgctgtcgtttaatgaaagtatggtaagcggacgaagcaacattgcaattaatccgctacaaatgaccgcttgtattgccaagaattgcggatctcgccagctctcttgagccaaagagccagctccccattgtgccaagccctgtgcttcttcagggtaaaacaacatcatcaaagcagagaatgaaccaaaatagagattaaccaccaaaccggccaaaatcagcaacagtggcgacattgtttttcgcattgctaacgtcagaacaagaactaggcttaaaccagccccaactaacgcaatggcacttgagcttatatctagccaattcggcataaaaatagccgtgataaacagggcaaactgcgaacccgcactgatcccaagcgtattatcggaagccaatggatttgccatcacttgttgcaacaataaactcgctaaaccgagcattccacctgccaatagggcaatggcaacgcgtggtaaggtgtagctttgaattaacaaaatatccagattgtcactggcttgaaacagactaacaagggattgctgttcaggcagttgcacgccgagtagccacatcatcagcccgataaaacaagcagacagtagaacaaacaacatctgtggacgatttaccattgctcgcctccgtgaattaagccatttgccagcacttccgcaaagcgttgagccgatggaatagccccgaatgtccagacttcaggcaaaatcagcggatctttcgccattgccagtttttgccataaggtgttgtatttcaaggcagaacggatatttgacgggtaaggtttaaccaccacaaaacggctttcagacggtaatttcgccagttgggtcacttcgataacttcaaagccccagctgttgtgattaccttgccagctgtttttaaaccccagttgcgacagcaccgcaccaaacggactattttctgcataaactcgcagatgacgtgtgtcgataaactgcaccaacagcactgggcggtcggtaaaaggttttacaagcggccggatttcggcaattttttgccaatacttattcaataaacgatctgcttgttcaggctttccaataatatcggcaatttgcttggtggcatcgaccacgttttgccacgcctcgccttctttatagaaatccactaaatgcaccttaccgaatttttccaacatcggcgtggcagacgcataaaatgaagagttgataaacagcagaggctgagcctctagttgtgtcgaaagttgccaaagctgttcagggttcggttgtaaacggataccgagatcaagcgtattttcgggcagttttggttccgatacccaaactttgtaattttttgcatcgccaacggctttgggttgttcatcaagggcaatcaaggtttccgccaccgtccaatctaaagtcgccaaactgcgttgtggttcgcctgcaaataggggatttgcaaaaaagagggagaaagtgaccgcttgtagccattttcccctctcccgcaaacgggcgagagggttatttatcaatatcttcatactaataaaaactcacaggtctgcccgtttcggggtgattgatcacattcagctcaatgccataaatcgccttcaaagacggggtattgatgatttgttgagaattgccttcagcaagcaacttgccactgtgcagggcgacaagatgatcgcagtagcgagaagcaaggttaatatcgtggatcacaataatcacccccaaatgaagctctcggcttaatgtgtggatcagctccatcacttccacttgatgagcaatatctaacgctgccaaaggttcatctagcagtaaaaattgaccttgctgtgccagcaacattgccagccaaatgcgagaacgctcgccacccgatagcacatcgaccaactgatcggcaaatttttcggtatgggttaaagccaaagcacgctcaatcgcctgtttgtcttgagccgtttgacgaccaaaaagcccattccacgcataacgccccattgcgatcagctctttggcggttaagttagtggcttggggaagatgttgcggaagataagcgacacgtttggcaaactcacggtttgaccaagcgtcaagcggttggttatcaaaaagaatttcacccgatgaaagcggttgctgtttggcaagcaatttgattaacgtggatttgcccgaaccgttatgcccgatcaatccatacatttttccttcgaaaagtctgttgccacgcccacttggatagcaaaaatgattactgtggcaattgcccgaaattgaaaaaactgccgaaagatgagttgatggaatgggtgagtaagctctgctaatcttcaaaatcaaattacttaattcaacttttacctttagtatttacacattcactagatactatctatcattcacaaggcaagatcttaattgctaatccacctgttgaagtttcgcggtatttcgcgttcatatctttccctgtttcatacatcgtttcgatcactttatctagggttacgcttggttgtgtcgttcggcgtaatgccattcggcttgcattgattgcttttaccgaagcaatcgcattgcgttcaatacaaggtacttggacttgtcctccaacaggatcgcaagttagccccaagttatgttccattgcaatttctgccgccatacatggcgtggtaaaaagtcgtaatggaacggcatatccgcaaaaaaatcaaaggtgattgttttagcatgttccagtcttgcttctgcaagacataaattttggtgctgtttgacatcacttacgaccgtatcaatacgctcaatatctacattgtctggcagatagcccattaatcccataataatcgcgatatccgtactgtgcccacgcccagtcaacgctaatgagccataaacatcgacttgcaagcggtcagtttctgccaattttttgcaatcaattaaatgatcaataaattctttacccgctttcatcggaccaacggtgtgggaacttgaaggcccaattcccactttaaacatatcaaagacactaatcataaacacactcaaacataagccactcaagacatattttagcgtaagttctctataagaggaatgttaccgatttatgtatatcattttggttataagttagagccttcagttattttaattttttcactaaaaacggtagattgagctggaattttcaacttagggaacttattatgcaatattcaaaactctttctcggcttgggttttctttctgcttcatgtgccgcgatttcggcaccgacaaatacattggtcaactgtattgcgacagcaccgatgaaacttagtccggcaattacaaatgatgctaatgacttcaatgccagctcacaacaagtctataaccgcttagtcgaattcaaagccggtaaaattgaagtagagccgggtctagccgaacgttgggaaatcagtgaagacggtttggtctacacattttatctacgccaaaatgtgaaattccacagcaacaaaacctttagcccaacccgcccgttaaatgccgatgatgtggtgttctcattccaacgccaagcggacaaaaatcatccttatcataatgtttcggcaggaacctacttctactttaactggatgaacttaccgagtatcttaaaatccgttgaaaaagtggatgactacaccgttaaaattacgctgaataaaccgaatacgccgtttattaccacggttgccatggactttttatctatttattcaaaagaatatgccgatcagcttcttgcccagggtaagcccgaaactcttgatcaacaaccgattggaacggggccttttattttccaaacttatcagaccgaccacgcggtacgttacactgctaacgtagattattggaaaggcaaagcagacattgaacgtttaatttttagcattacccctgatgccggaacacgttatgccaagttaaaagccggcgagtgtgatgtgattgattttccgaatatctcggacattgctcagatgaaaaaagatcctcaaatcaatctacttgagcgtgagggattaaacttagcttacattgggctaaataccaccaaacctgaactaaacaacgtaaaagttcgccgagcccttcaccatgctaccgataaaaaagcgattgttgatgcggtttatcaaggcggcggaacggttgcaaccaatccgttccctgatgcagtattaggttataacccacatttgccacaatatgaatttaacttggaaaaagcaaaagcattattggcagaagccggctatccaaacggttttgaaacggaaatttgggtgcaacctgtggttcgtccatccaatccgaaccctcgccgcacggctgaaattattcaagcagactgggctaaaattggcgtgaaagcaaaactagtcacacatgaatgggcggattttaataaacgcacccgtgaaggcgaatttgccgcaggtacttatggttggacaagtcgtaacggtgatcctgataatttcctattccctttatttagccaagcaaatatccccggcaccaattactctcgctggacagatgaaaaatttgaggcgctactcgcctcagcggtacaaactcaagacacacaaacacgtgcaaaactatatcaacaggcagtcgaaattttccaacaaaacagcccgatcattccgtttgcccactccattaactacgtaccgttaaataaacgggtacaaggctttgttcaaaatccgtttggctataccgcattttatggcgtaagtctgaagccttaatctattagggagcttaaaatattaagctcccttatataagtctttctaaaaataaatcgtttacatcatttacttactattttgatccacagttgatagaatcctttcatatctacactaaaaataaggaaatatgatgtctaaactctttcccaatgcacaacctcgtacccaagccccttatcgttttgatattgtgggaagttttctacgtcctgaaagcttaaaacatgctcgccaacaatgccaatgtggcaatttatcttgtagtgaactgactcaaattgaagatgctgaaatcacaaaattagttgagcaacaaaaatctgttggattacatgctatcactgatggagaatttcgtcgtactttttggcatttagactttttagccgcactaaatgaagtaaaagaaattgaagcggaaaaattctctgtgcaattcaaacatcacagtgtccgacctaagacattaaatatcgtagacaaagtagaattttcggatagacacccatttttagaacactatcgttcactccagactatttcaggagatttccctgtcaaatttacgatcccatctccatcaatgctacatctcatctgtactgtacgagaaaccaattatcaacctatctctcgctacaaaaataataatagccagctattagatgatattgctgatgcttataaatcggcaatagaaaaattctatgcattaggttgccgtaatttacaattagatgatacaagttggggagagctttgttcagaagagaagcgagctgcttatcaagctcgagggttcgatttagaacaactcgcaaaagactatgtttatttagtcaatcgcgccaatacatagacattaaccaactctgtcttagtccacaatgtggctttgcatcaactgaagaaggtaacattctaacagaagagcaacagtggaataaattaaaatttatccgagacatcgctgaagaggtatggggtaaataatacatttaatttataaagcggtcggatttgcaaaattttcgtcaaatcccaccgcttgttaatcaattaagccctacgccacattgtaccatttgcaccatcttcaagcacaatgcccattgcggtgagtttattgcgtgcctcatcggctaccgcccagtttttgctggctctcgcttcgttacgttgtttaattaaggcttcgatttctgccacttcatcattattggcatcaccttgtaagaaggtttctggatcttgctctaacaaacctagcacgcctgcaagttgtttcagacgagctgcaagtttgttcgcttccacctgattttctgctttgagtttgttgatttcacgggctaactcaaataatactgctaaagcccctggggtgttgaaatcatcgtccattgattctttgaaagcggtcacatactgatcgttttctacaagttcgacattccaatcacagccacgcaatgccgtatataaacgctctaacgctttgcgagccaagccgatattttcttcgctgtaatccaacaagctacggtattgtgcggttaagaagaagtaacgaacactttcacaatcatatttgtttaaaatatcacgaatggtgaagaagttattaagcgattttgacatcttctcttcgttgatcgtaagcattcccgtgtgtagccaataattcacataatcgtcaccgtgagcacagcaagattgtgcaatctcgttttcgtggtgagggaacattaaatccgaaccaccgccgtgaatgtcaaaatggttgcctaactctttgctgttcatcgccgaacattcgatatgccagcctggacgacctttgccccaaggggaatcccagcttggttcattctctttcgacattttccataatacgaaatccatcgggttgcgtttgaccgatttaatttcaacccttgcccctgcttgaagctgttcaagattttggcgagataaggcaccgtatttttggaaagattcgacattgaacatcacgtcaccatcttccgccacataagcgtgacctttcgctaagagtttttcaacaatcgcaataatttcagggatatgttgcgttgcacggggttcaacatcagggcgaaggatatttaacgcatcaaaatctttgtgcatttcgatgatcatacgatcaacaagctgatcgcaagtttcattattttcaaacgaacgtttgatgattttgtcgtccacatcggtaatgttacgcacatagcgtaagttatagccgagatagcgaaggtaacgtgcgatcacgtcaaaagaaacaaaagtccgtccgtgcccaaagtgacagagatcgtaaaccgtgacaccacagacatacattccaacgtgatcagggtggataggtttaaattcttctttttcacgttttaaggtgttataaattttgagcattatttcctctattatttaataaaaaattgtcaatccatctaagaaaataagaggaaatattatatttatattcttcatttaataccaaatttctcttttaaatcgctttcaaatttctgtagttctttattcagtaacaataatctatctgccttttctttaattttttcctgtccttctaaagtcgggttttgcatagtttctactgattcaataataaaatcatttaataaaatcagattttctttaatccttaatttcaataactgaatatccgtatttttaacctctatcatctctagattttgtataatagaagatattctagttttaaagatattcaatccctcttcaatttcagatttatcttgactgttcagcttttgttgcaattctgctaatacctgttcttgcttaatattccataataccaacttattaaagtcttccacagcttcaatagaagccgaactctccactgtatgcacatcttcttttgatgttttttctaaagaagtactattgatactctcatgctttccgacattatcacaagaagataaaaacatcatacataatactaaggtaataattttaataaacttattcatttcaaaatatccaaataatactaaaaaatctttattaaatatattcatataaatcattcttatccagttattacacacttattgcctgctgaataagtagcttttttacaaaactattttgattagttgcagataatccaacacctctaactaattttttaaatggattattgccagagaaaaggtgctttaagccctccattgcaactaaaacctttatcgcttctaactttctaactcgttcaaattgacgtaaattacggtactctcctatatcttttccaaaggagagtaatttctgtagctcttttgccaatagaatagcatctgcaaaacctaaattaacacctaaacccgctagaggatggatcgtatgagctgcatcaccaatcaaagcaatcctttgctgggcaaaatcgcgagcataacgtgcggtcaaaggataaacatccctttcactttgtaactcacatattcctaattgattatcaaaagcaatattcaattgtttgagaaaagatttttcatcactattaactagtctactagcctcaagtgtaggcaaagaccaaacaatagaacaaagatgttcatcttttaaaggcaagaaagctaaaatactatcaggcgaaaaaacttgacgagccacttgttgatgcatttctgttgttctcacattacatactaatgcagtgtgttgataatctctactaatcaatggaattttagcttgttgacgaacccaagaatgagctccatctgcacctataactaacttacttgtaatcatctctccgttttctagagttaaaaaagcgcagttatcattaatgcctaaaaatttaggagcatccaatatcacttctacattatgctgatgaatgacttgcttccatagagcataacgaatctgctgattatcaataataaatcctagctgctctagtccaagttctttgattacgggatctttattgtcaaaacagagacttgaaaaactatccttttcccagacatacatttggtcataaggagataaatcactttcagaaatatgataccaagcacctatttcctcaagcattctttggctagtaaaattaattgcacttactctattactgattgacttacttaaataaggaactgttttatcaataatcttgatttgacaattactatttgcaagtaatcctgctaaagctaagccaaccattcctccaccaatgatggtaatatctgctgttttcattctacgatgtcttataatgtttttctaaactacagtgacgaactcttacttttttgcctttactttcaatatacctggctaatttctctgcaacaaatacagaacggtgctttccgcctgtacagcctatggcaatcgttaaataactcctattattttgctccaataaaggcaaccacacttctaaataattacaagtatgagaaataaattgatgaacttctggctgattttctagaaaatctataacaggtttttctaatcctgtcatagggcgaagctcaagattccaatggggattaggtaaaaaacggacatcgaaaacataatctgcatcagcaggaatgccatacttaaaaccaaaagattcaacaataatatttaattctttctccgatgatccatttaataattctcttaatttctctgctaactcatgtgaagaaaagtacgttgtatcaataatataatccgcatgctgaaataatggttcaagaagatgattttctaaatcaatcgcattttctaaagataaatcattggtaaataatggatgtaaacgacgagagtcactataccgacgaactaaagccttacgctgacagtcaagaaagattaaagtttttgaaatgtgagaaggaaacgcatgtaatacttgctcaagcacatctggatcttctggtaaatttctcacatcaaggctaacaacaacagatctcttcaatttttctaaataatctgttaactggggaattaaagcaagaggaatattatccacgcaataataccctaaatcttccaacgctcttaacgcaacagactttcctgaaccagatcgcccgctcataataatcaattccacattacattcctcgattctaaatttttgtttaccgaataatcataataactcaatacttgccaaatttcttctctggataatgcagctcttagatgctttaacaaattcttatcacttaattgctgtgctatttctctcaaagaatccttatattctacacaaattttttccgaaaagaatatggcataaataatatccacatccttatgatctattgattcaaaatttattcctgcctctagtttcaggaaaatagcaattggtttctctagctgaaattcttgactcatcaacaattttgcgtgaggtaaagccactccattattaattccggtagaacctaatttttcacgtttaaagaaatagctaaaacattctgctggatgaatacatagtttatctgtaggtgaaaggctattatttaatatttctgccatcgccttccccagaaactctaaagcctgttttttattagaaatgggaacattgtaataaatattattaatatctaaaaatgtggttaattgcatcataaaaaatcaaacgacaaaaaaatatcttaagaattttatattacagtctaaattgctcacctaaataaacttttttcacatcctcattatgtaaaatttcttgaggaatcccactagctatcatctgaccattactcacaatataagcacgctcacaaacatctaaggtttctcttacattatgatctgtgattaaaacacctaatcctcgttcctttaaattcacaataatcttcttaatatcgatcactgaaatagggtcaaccccagcaaaaggttcatccaataaaataaacttaggattagctgccaacgcacgtgcaatttctactcgacggcgttcaccgccagataaagattgccctaagctgtgacgaatatgctcaatatgaaattctgcgattaattcatctgctcttgcttgacgctctgcatcggttagatctttcctaatttgtaacaccgccatcaagttatcataaacacttaagcgacgaaaaatagaggcttcttgaggcaagtaaccaataccttgttttgctctatcatgcataggtaaaacactgatatcttgatcatcaatacggattttaccatgatcgtgacgcacaagacctactaccatataaaaagtagtcgtttttcctgcaccattaggacctaatagtccaactatttcgcccgatttaatatttaaacttacatctttaacaacttggcgacttttataacttttagccaaatattcagcatataatgttggcatacagaattcctatttcttatcactttgcaattggtttggaattaatacagtttttactctttgtcggtcattactcgtcgctttaaggttctgttttttgacatcataagtaattttttctgctttaatggcactatctagctgctttaattcagcattgcctcttaatatcaaaaattcagaatctaaatcataatgtacagaattagccgtaccattaacaatcttaccattatcaagggtctgctgaaaaacaaccggtgtgccaaaagcctcaataagttccttttgagtatcccttctaatgattgtaactttttctgcattaagcttaattgacccttgagtaacaacaacattgtcgctaaatgtcacaatatttctttccatatccaatgactggctacctgaatcaattttgatgggcatatttctatctgtttccaaagccttaaccgatagatttacaagacacaatgcaattattaatacaagtttagttctaaaattcattctatatccctatgtaaaactctaattatttatcaacattaataaattttggttcaatataagttttcacatctttggttaaggttgccgtttgttttttcaaattgccttttaagccaattccagtacttgtaaatccaatacctgttgatttcaccatactgtctgaaaaaatatcttgagtatttaaatctatgcttaacacttctgcttcgattttctgtaaccgagaagtcggatctaagctattaattttaacatttccacgcaaattcaatattttatctttggtaacatctgcataatcggcttcgacttgccactgttttaatgcactttctgcatcaaataaattaagtaatggctttagaaattctgttcgttgcgtattttcgtaacgtttaacctcttctgcttgagcaaaatattgcggctttccatttaaatcataagcacttgtagaaatcttttgccctatatactctgcacttccttccttctttattagctgagacaatccagtaccattgctttgttgactataataccaaccagcaagtactgctgctaatgtggctagaataatatttaaacggatattcatacaatctcttcttcgtttagatacagctgagaattttaacataaattcctacggcaatatagaacgaaaattgcaagcaaagttcatacaaaaaacctcaaggtaagccttgaggtttttaagcgatgtctatgaattacttcgcagcttttaactcttgataatatttttcatagagttcaatcgcatcacccacatcatcttgccactgacttttttgtaacacttcagaggttggataaattgctggatcttcggtaatctcttttggtaatttttctaacgcttttacgtttgaagttggataaccgatttctaatgttaatttctcagccactggcgcacttaataggtagttaattaacttatgcgcaccatctgggtttttcgcattagatggaattgcaagcgtatccacccataatactgggccttctttcggaaacaccatatttacaggggcttgttcttttttcgcaatgcgcacagaaccattccacaattgacccacttctacttcacctgaaataaatgagtttgcaggattgtcagagctaaatgctaatacgtttggacgtaattttaataactcttcataagctgctttaattactgctggttctttagtatttggatcttgacctaattttaataaagcaatgttgaatacttcacgagcatcatcaagtaattgaactttacctttaaactcaggtttccataaatcaccccaagcggtgaaattgtcaccattgtatgaattagtattaaatgcaatacctggcgcacctaataattgtggtaaagagtatttgttgcctttgtcgtaaggtttatttaaccagtctgggttaagatctttgatcacaggtaatttgctatgatcaagttccattaacataccttcacgacccatttttgacacgaagtagttacttggtgcgattacatcataaccgccatctttgccctgaattttgagtttcgcatacattgtctcatttgattcaagacttgaaaccacaaccttaatacctgtctgtttagtaaattcttctaacaaaccttctggcacatattctgtccaagtataaagatgtacagtgtcatttgctaatgcactatttgcccctaacatcaccatacccgaagtgaatgcaacagcccattttttcatcaatgtgttctcctaaaagagtaaaataaagaagaggttggattactccaaaaaaaaccaagtctttcaaataaaagacgggggaattctaagcccccccctgtattttgcaacaactttatttcaaaatagattattttttaagctatcaagcctaatattacattactactacgtcaaattgatcttggtgataatacggctcaattttaatttcgacttttttaccgataaaaacttctaattccgcaagcaatgcgtgagattcttcattaatcaagtattccgccacgctacgagaagcatatactacataacgttccgatttgtataaatgatgaactcgaaccacctctcgaacaatctcataacagactgtttcaacggtttttatcgtacctcgccctttacacgaagaacaatcgcaacataacactcgttcaaggctttccctggtacgtttacgcgtcatttcaaccaaaccaagttgggtaaagccattgacatttgttttaactcggtcgccttttaaggcaagctctaaggactctagcacacgctgacaatgctcttcttcctgcatatcaataaaatcaataatgataataccacccaaatttcgcagttgtaattgatgtgcgattgcctgtgttgcttcaatgttagtattaaaaatcgtatgtgcaagatttcggtgtccgacaaaagccccagtgttaatatctatggtggtcattgcttctgtctgctcaatgattaaatacccacctgattttagatcaacacgtttatccaaggctttttgaataccatcttcaatgcgataaacatcaaagaggggtaaagtcccactatataaactcacattcttggctaactctggcataaactcagctaagaactcttttacctgctcataggtcatttttgagtcaatttgaattgaatgaatatgcgttccaacgaaatcacgcaacactcgttgtgccaaagctaattccccataaagtaaagatctcgcaggatattttccttttcgctctagtacttttcgccataaccgctttaagaaagccgcatcttgttcaaggctctcttcgctcacactgtcagcagccgttcttacaataaaaccgcctagctcatcacaatacggctcaactaacgattttaagcgattacgttcttcttcactttcaatgcgttgcgacacgccaacgtgactattttctggcataaaaaccaaataacgagagggcaatgtaatgtctgtcgtcaatcttgcccctttagtacctaaaggatctttgaccacttgcaccacaatatcctgcccttctcgcactaactcgctgatatttttgacaacaaattgctttttctcgctttcatcaacacattcagtatgagaaacaatatctgaggcgtgtaaaaatgccgctttttctaagccaatatcaacaaatgccgactgcataccaggcaaaacccgtgtcactcgtcctttatagatattaccgacaacacctcgctttgcctcacgctcaatatggacttcttttaacacaccattttcaaccaatgctaccctcgtttcacttggggttacattgactaataattctgcacaattcatcttaaatttatccctagaatcatttacaaagatactagtactgattttcttaaaatatacataaatagttatttaccataatagaataaaggtcctaatggcatctgaggaatactaaatttctcaggataaataacttcaaccaagtatagtccctcagctttcgctgttggtgcagccaacgtcctatctcgtttttctaatagccatttaatccattcaacaggtttatcgcctcttccaacctcaatcaaactaccaactatatttcttaccatgtggtgaacgaatgcattcgcttgaatatccaatataatatagtcttgatggcgactcacaatgagatgatgaacatttctccatggcgtatgtgattgacacttcgcagctcgaaatgaactgaaatcattctctcccaataaaaactgccctgcttcatgcattttttcatgatccagagaatagtgataatgagaaatccctttcggtaatatggctgaacgtaatttattattataaataacataacgatagcgacgagcaagagcactaaaacgagcatgaaaatcgtcacttactccaatagcccatttcaccacaatatcttctggtaaatgagcattggtccctaaacaccaactctgcataggtcgatttacatccgtatcaaagtgtacaacctgcccagtagcatgtactcccgcatcagttcgccctgcacaaaacacttcacaagatgaatttgcaatgactgataaggcttcttccaatctttgctgtactgaatcaacatattgttggcgctgccacccacaataacggcaaccatcgtactcaattccaagggcaattttcattagacaacctaaaacatttaattaatctgattaactcttttttttcataagaaagtaacttgataagttactatagctaaatcgtattatttataccgctgcccgtatcatttaatgattgacatccaaacaaaaacagccagtaaatcattttattcagagattaattcgctcttcgggcattatgccagattagtatttaatttaaaacaactacacaattttgcccccgaagagaatacagcatcagtaaactcatgcagatattgtaaaattaattattgtggaaaaactcaaattcttccctacttttactgaacatttgttcttttagaacgccgatcagctcttgtctgacaacagaaagttttggtcgttcattttgttggaacaccactggacgacaaaattccattgccttaatgcctaagcgagcggtgagcagtcccataccaatcccttgtgccgctcgaaccgataaacgagcggtgagattttgtgagaaaaaatctaacccgacatcgctggcaatttccgttgcccctgcaaagaccatattggtcatcaccattcggaacagttttaaacggctgatatagcccaattccataccgtaggctttggtgattttattgactaaagcaatgtttcgccacgccaccattaaaatatccaccaacgccaaagggcttactgcaacgataattgcattttccaccgcatttttactaattaactttttcacttggttatcaatcgggcttaatacattttcactgaaaagatacagcacttctttgctgttataagcttcgtcaagctgaaattgccaacgctgttccgcctgttgaaccatcggcgtttgagccaaatttttaaccaccaatttgcaaaattctcgtgctttttcaccgcttgtatccgctgtttccagtagtaattgttggctcatttgctgatgataatgatgtttacgcaaccaacgtaactttctccattcgttgataatagcccctacaccagccaaactgatgccaaaaaaggcaacggcaaaggcaaggtagatccactgatttgcttgccaagtatcaattaaccattgcactgattgagcgatagtcgcaacgccaaacagagccaacgcagctagaaataaccttagccagaagcgagagggttttaaactttcttcaataatcagttctgcttcaacggcttttggatcttcgtcaagctgaatgtctgcgtcgctaaactcttgttttggttgatgttttacttctgtttcaaccatttcttcggtaaaaatgcgtttttccattaagatctcaccgcttgtgtaatgtgttgctttaacccttcgtagccgtgttctgttttgagaatatcaaacagttgcaccgcttcgggatactctttatcgagataacgtagccactgtttaatgcgtgcgacgtgataaaagccggtatccagttcgttttccatatgtacatattgaaataagagctgtaatacctcgttccacgccattttaggctgattatatttcacaactttgcttaaatttggcacatttaacgccccacgcccaatcattaacgcatcgcaagcggtcacttcacggcatttttttgcagagagataatcccaaatttcgccatttgcaatcacaggaataggcaaccgtttttttatctcgccgatggcttgccaattaatacgttctgctcgatagccgtccattttggttctgccgtgtacggtaatttccgttgcaccgccttgcaccaccgcatcggcgatctcaaaggcttgttcgctactatcccagcctagtcgcactttgaccgacacaggaagatggctaggcaccgcttctcgcattgcttttgttgctcgataaatcaactcaggttgtttcagcaaggacgcaccgccattactgccattcactgttttagacgggcaaccgcagttgagatcaaccccgtgcgagcctagttcaacggcaagtgctgcgttttctgctaaccattgtgggtgttgccctagaagttgtactcgcacaggcgtacccgatagggtaaaaccgttattatgtaattcagggcaaagacgataaaaggttttcttcggcagtttttgatcgaccactcgcacaaattccgaaatgcacagatcataatcattgactgccgttaataattgacgcacaaaagggtctagcaccccttgcataggtgcaaggataacttttggtaaattttccacaagatccgaccgctattagtaagaagaatggcgtaaacgtaggtcagggcgagcaattaagtagatgattaatgcggtaattgcccctagcgtatcggcgagcatatctttttgtgcgtcccaaatatcgccttgcgaacctaaaaattcaatgccagcattacccccttcaatcactgcatattgccattcaatgatttcgtaagttgcggcaactgccataatgaaaaagagcgagaagaagaatgccacacccaagccgcatttacgtttacgcaataaccattctgccatcgggaaactataaaagccgataatgtagtgagccacacggtcaaagtggttacgatcttcgcctaagaaggtcaaatactgatttgcccaatcaaacggcacattcgcaaaggtatattttgcaccgatgaggtgcataatcatccacagtgacatcagcacataggcaagcccactaaattgaaaacgttgataagtgagtagaagtagagcaaataccacaaaaatcggcattacttctgcataccagacggctctgtctgtcgggttaaaaccagaccatacggaaacaaccgtaatcacaatcgctaagaaaagcggaacgatatgagaacttttttgcattatttccaactttttgatttacaaataagatcataagcagcttgaatttgctgtgctttttcttttgccacttccatcatttcaggcggtaaacctttagcgactaacttatctgggtgatgttcattcattaatttgcgataggcacgtttaaccgtcgtttgatcgtcgctttctgacacccctaatacgctataagcatcttttaaacttggttcacttgaacgctgataaccaccataatttccttgatattgtccttgttggtttgagccttgctgttcatattgataatagcctgagcggaaacgttgagctgctgccaccattgctatcatctgctcaaactgtaaacgagacattcctaacgtttcggcgatagtgaataaaatttgttgttcattgccatctaaattgccatcttgtaatgcagcttgcatttgaacttccacgaagaaacgcaataaatcacggcgttgtccacaggcttcacggaactcttgcataacttggcgtaacgggaaattagcctcttttcctaaagtaaaggctttttgagcaagttgttgattatttgcatcgagtttcatattcgccattaactgacgggcaagctggatatcattttccgttactcgtccttttgctttggaaatatgtcctaataccgcaaaagttgtctgcataaagagtgactgacgagttagtgctttgccaaacatagttgaagatacgctacctagctcatacagttttttatcgccccaatgcccaataataagccctagcaaaccgccaaaaaatccgccaaaaaacttataacctaaaatgaaaccgagaattttcccaataaattgcatcgactgcccttacttacttattcaaaattgtgagcattttaacggaaaatccttaaaaaataattaagtaatatagaatttacacataaaaataaagccccgaattttcggagctttactgtttggcattttagaaaactaaaaattagtactctaacactgcacgacggtttttagagtaatcagcttctgagtgacctaatactgctggtttttcttcaccgtaagaaactgttgctacgttgctagcacctttagttgctaaaacatctttaactgcgtcagcacgacgttgacctaaagcgatgttgtactctggagtaccacgctcatcagcgtgacctgcaacagttactttgcctttagatgcaactaagtattgtgcgtgtgcatctaaaagttgttgatcttcagcttttactgtgtagctgtcgaaatcaaaatatacagtgttgtaacgggtttgtaaatcttgagcagacataccaccgaatgtttgacctgcattagcacttgcgttgtcatttgagctgctgcaagctgctaaaacgaaagctggtgccgcaatcattaaaactttagctagttttttcatttttttctccaaaaaagaattattgtttagtcagataaggtgaccaagcagggaatttatattgtccacctgctcccggcaaattagctttgaaacgcccatctgcggacaccaattgtagcactttactcacacctttggtagagctataaataaccattgttccatttggtgaaatacttggactttcgtctaaaaacgtagaactgattgcttctgtgctacccgaaacaagatctcgtcttacaattctatcacctgaaaccatgattaaattcttgccatctgccgaaattttaccactgccgctgccaccaattaagctagcaccaccaccagatgaactcatttgataaacctgtggtaagccaccacggtctgatgtaaacaagatataaccaccatctggtgaccagcttggttcggtattatttcctgcgttactggttaattgtcttggtgaaccaccgcccacccctgttacataaatatttaatacaccatcttggttagaagcaaacgccactcttgaaccgtctggtgagaatgagggcgcgccattatgccctctaagagatccgaccacttttcttgctcccgaacgaatatcgtgaacaacaacctgtgattttttgttttcaaaagtcacataagctaattttgaaccatctggtgaccattctggtgacattaaaggctctttactttttacgatggtaaaggcgttaaaaccatcataatctgatacacgcaactcgtaagaggacactccacgttgtaccacataagcgattttagttctaaatgcaccacggatctgtgttaatttttcaaatacttgatcgcttactgtatgagcacctaaacgcatttgagctgctggaacattaaatgaaccttgtgcaatcacattgcctgctgcccctgacgttcctagggtatccactaattgataagcgatgttatagccaccacctaccacagatacttgcccaacaaccacattatcaatgccgatattcgtccactgttcaggattaacttctaccgctgaacttggttgtgcaggtaaactcgcacgatcaagcggtgtaaacttgccactatttctcaaatcatcagcgataatttgagcgacatcatcaggtacgcccctcattgctttaaatgggataaccgctatcggttgagccatactcacaccttggtcaatcgaaattctaacatctgactcagcttttacactaacagaaaaaaataatccgataacaccaagaatactcgttaaacgagatactaatttcatcttaaccctctaggttgaactattgaacttttaaactaaaatctaatgttggtgacttatattgctgataaactgcatctgatggtgctggtggcactttacgggttgccacaattgcacttacagccgcatcacacactgctttatcccctgaaacgacttgatagttggtaatagtaccatctcgctctaggaaaattttcacatcacattgtttacctgcaaaactcggatcaacacggtattttgactgaataagttttttaattcgctgcccataggcattgccatcaacattagcaccctgacctaaaccttttgtaccgccagagccttgtgagccagcactatttttattaccgccgttgctcgtgcctccgccaacttcgccgccacttaaaaaatcatcaagcgctttattatttttcgctttttcagcttttgcagccgcttcagctttcgcttttgcctctgcagcagctttagctttcgcttctttttcctcttttgccttagcttctttctccgcttttagttttgcttctttttcagctttgagcttctcttctttctctgctctttctttagcctctttttcggctttgagcttcgcttctttctctgctttttctttagcctctttttcggctttgagcttcgcttcttgttctgctttctcttttgcttctttttctgcttgtgctttagcttgctgttctgcttttagctttttctgctcttcaagtcgtttttgttgctctgcttcttttattttccgttcttcttccgcttgctttgcaagggcttctaaacgttttgcttcggcttcagctttcaaacgagcagcttctgcaagtttacgttgtgttgcttcttcctgctgttttttcaactgttcttgcttaatttgctcttgtttcaatgcttcttgacgagccaattcttgctgacgtttttcttcttgttgcttctgctgagctaactgaattgccttctcacgttcttgttgttcagcaatttcttctggggtaggtttatcttcaacctcttccttaacttcctctttaggctcttctttaggttcaaccttcgcttgcccttgcttttcagcttttaatcgcccatattcagcggctacctgtccagtatcaacaatcacagcttcaagagattcactatcaccgccacttccgccagcagaagctaagtgagtattagtgaaaaaagaacccagtattaataagcctatcaacaataaatgcagtaaaactgacacaattatagcgagttctaatctatcattttgatatttcacgctctatcctcgctgactatttaccttcggtcattaaacctacggttttgatccctgcatcttttaataatgagatacctttcattacctcttcgtaaggtacatctttaccacctgccacaaggaataaggtattattgtccttttggaaagcctcaccagcataagcaatgacttcttgctccgctaagttctcttgttcattaacttgaatgtagtttccgttaattttcaatttgtacaaagcgaccccagcgatctctaaaataacaggggttttatcttcatttgaaacggattgactatggcgatcttcaggcaattccacttcaacactttgactaataatcggtgctgttgccataaaaatcagcaataacaccagtaacacgtccaaaaatggcactatgttaatttcagatttaatgtcattacgtttacgacgacggtaagacatagtttcctctttatctatccattcaaactaccgcaacaagcagtagcatttcacttaatttttacttatttttttcgcaaacgcttggcgatgtagaattgtggtgaactcatcaataaagttcacataattctgctctaatttgcctacacgcaagttcaaacggttatatgccattactgcaggaattgctgcaaataaaccaatcgctgtggcaattaatgcttcggcaatacctggtgcaacagattgtaaggttgcttgttttaccgcacttagtcccataaatgagtgcataatcccccaaactgttccaaataaaccaatatatgggctgatcgaaccaacagtacctaagaacggaatgtaattttcaagttcttctaattcacggtttaatgcaagattcattgcacggctagaaccttgaataattgactctggcgaatctgggtttgcttgctgtaagcggctaaattctttaaaaccaacgtagaaaatttgttcagcaccagttagaccatctcgacgatgttctaacccttcgtgtaaacgatgtaaatcttcgccagaccaaaaacgatcttcaaaggctaaagaatcttttttagcttttgttaatacgcggctacgttgaataatcactgcccaagataacacggaaaaagagatcagtattaagataactaacttaacaacaatactcgcttccataaataatgaaactaaattaaattcagttgccattgataaaaactccaaataaaacaattacattgagattatagcgttaaaagcctgcttaatatcttcaggtatggcgatcgctttcatttttgacagatcaacactcacaacaaccacactcacttcacacaagcactcttcacctcgccataacgtctgtttaaagactattttggcaccctttagttcagaaataatgcttttaactgtgagaaaatcgtctaaataagcaggtttcttatagtcaatctccattttcttcacaacaaaagccattgattgactgagtaatagctgttgagaaaaccctaactgacgtaaaaattctgttcttgcacgttcaaaaaaatgtaaataacatgcgtgatagactacaccgccagcatcagtatcttcataatacacacgaataggaaaatccattgcaatgccctatctatctttccaaaacgaaaaacgccccaaaatcaggcgtaaattactcgtcattctagagagagaaaaatcgttgtgcaagtatttttagaaacaaattgaatataaaataagcaatatgataagaacccgttgctttgggttcttaatttaaagactaatgcaatacgactaatgcaattagtgaaggtaagataatgatataccccaacaatggcataaaaacgacctgccatctcgttgatttaatctcaaagccaaaaccgtgaacaaataaaatcaacataccatagaaaacacctgcgactaagtaaggaattttccctccaaaatagagagcaaaggtgttggaatagagcaatatcattgcaaacattgcaatagaaaggataaaagaaagggcttgtagccagccctttcttgtgagttgatagagtgaattaatcatctcattactcgtcaaacttacctgttttttcaatacttacagtgattactgttgcaaacagaatagcaagtaacacacctagtacccaagttacataaaacatattggttctccttagtataaacttgcacttttctcttcaatatatttagcgtcaagacggccaaacattttggagtaagtccacacagtataagctaatacgattggaacgaagatacaagctaccacaaacataatcattaatgtgttatggcttgcagttgcgtcccacattgttaaactcatttcagggtgagtaattgatggcattacgaatgggaacattgcaacaccagcagttaagatcacgccagcttgcataattgatgagcataagaatgcaagtccaccgttatttgctttagagccaaccactgtacctaatgcaccgattactgctaatccaggaatgatgaataatactggcatttcaaagtagtttttgaaccacgcaccgctttctaatacgactgttttgttcactaaagtagattgtgcattgtgatctaaaacgctagttaccacaaatccatctttgaagtaaacccaaacaccagcaagtaagaatgcacctaacgccactaaagcggtcacttgagccacatttcttacacggttacgcaattcgccagttgttttcatttgtaaccaagttgcaccttgagtggtgagcatcattaaacttaccacaccgcaaagtaatgcaaatggatttaataagcctaataatttccaaagggttgaaccttcgtaagttacttggtttaactcattaaagtggaatggtacgccttgtaataagttaccaaatgcaacaccaaagattaatgatggaacgaaaccgccaacaaataatccccagtcccaagcattacgccatttttgatcatcaattttcgcacggtattcaaagcctactggacggaagaataacgcagctaaaaccaagatcatagctaagaaaaagccagagaatgatgctgcataaactgttggccacgatgcaaaaatcgcaccacctgcagttaataaccaaacttggttaccatcccagtgcggagcgattgagttaatcatgacacggcgttcaacattgcttttacctaccacaggcaatagggttaatacccccatatcaaaaccatcggtaattgcaaagccgattaaaagtacaccgattaaaatccaccaaataaagcgtagaacttcataatctaacatattttactcctacttatttcgcagattgttcaaaatggtaacgacctgtttttaatgcacttgggccaagacgaccgtatttgaacattaaatacatttctacaactaaaaataatgtgtacaagccacataataaaccaatagcaatccaaagatctgctgttgttaatgcagagtttgctactcctgttggcaatacctcatacactgcccaaggctgacgaccatattcagctaagaaccaaccgctttcaatcgcaatccaaggaagtggaataccccataacaatgcttttaataacaatggtttagtacctactgtaccgcgtacattttgaacaaatgctgcgataataagtaataacattaaaccaccggcaatcatcataatacggaatgaccagaatgttggacctacgtttggaatagtatccgctgctgcttttaagatttgctcttctgttgcatcaacaactttgtctgtatatggttttaaaagtaaaccaaagccaagatctttttgaactgctttgaacgcttctttatcttccacagtatagttgcctgaacgtaatttttctaataaaccgtaagcaacgataccattgcgtacacgctgtacgttctcttcacgaagatctttcaaacctttaatttctgtatctaaagaacgagtagcgataatccctgctgcataaggcactgcgatagcaacttcatttttcatctctgcagtattaggaataacaaacgcattccacgctgctggagctgggtgagtttcaaattcaccttccattgccgctaatttcacaggttgtgctttaccgatttcatagccagactcatcacccataattaatacagaaataatagccactaaaccgaaacttgcacctactgagaatgaacgacgagcaaatccaagatcacgaccttttaagatatagtatgcacttacacctaatacgaagatcgcaccacaggtatagcctgctgaaacagtgtgtaagaatttagattgtgttactgggtttagcactaagtcagagaagctgaccatttccatacgcattgtttcaaagttaaattctgaacctactgggctttgcatccaaccgttcgcaactaagatccacaaagcagagaagttagaaccaaatgcgaccgcaaaagtcgttagtaagtgtttaccttttgataaacgatcccaaccaaagaagaaaagaccaatgaaggtagattctaagaagaacgccattaagccttcaatcgctaatggagcaccaaaaatatcacccacatagtgagaataatatgaccagttagtaccgaattggaattccattgtaatccctgtcgttacccctagagcaaagttaataccaaataacttaccccagaactttgtcatatccttatacacttctttacctgttgttacatataaggtttccatcaccacaagaacgaaagaaagacctaatgtaagcggtacaaataagaagtgatagagagcagttaaagcaaactgcaaacgtgagagttcaacaacgtctaacatctcaaacctctttatatacaagtctgaattattcgattacaagaataccaagtaatcccccaatcaacattgttttcgcacagttactaatcaaagattaataagtagcaataatgtcaagaatctattctactcgtaaataagcaaataaaaaatagcaaaattattacattgatcacatttttgagctaaatatttaaaaaatatgaaatttatattgttataacttgatataaatcaagttagacaaaataccatacacttatctgtccaacctatttgtaaattatttatgaatataacttttaggtttaacaatttatttacatcaagaataaagatccttaaatagtacgtgacgatatatcaagatctatgttagtatacgcgaatttcatctaacagttaaactaatcattaggaacactatgaaaaacgctattttacgttcaatgattatcgcaactggtgcattattcattgcgataagtggtttcactactgaattgaaaacatcttcactggtaatgaccaaacctcaaaccaatggcatattacctgaacagtgccaaaaaatgtttcaagaagttgataaactgattgctgatgcagaaaaacaacctggtacacatactcaaatgcagacaatgaagaacaaactctcttcatcaaaacaacagatcctcaaattagatctcatcatgcagaaaaaaagttgtaataaagggttggttgcgcttaatggactgaaacacaatagcaatggagaataaagaacacgatctatgtgatctcataccctgtgatattactcccgacagtctaaatatttataatgatttcttaattgctattttgtctattacaccagctcctatattgataattctattcatcataataggttcccatatgaaataagtattctaaattcataaaaaaactgatctcatatctaaatataacgatttttaatagactaaaataatgaataatttttgttgattagaaagttaaagccttataacaataaggctttaacctaattcttatataaatttttgtatacaatcccttaaaaagctctctcatatgtcaggagcctattataggcaatgctacagattaactaaccgaattccaaatgggtaagttaaaatcttcttataatttaattccaaacttctcatctataagaggagcaaaatccgaataaccgccaacgtgaacatcatctaaaaagatttgtggcacagtcgcaacaggtttacccacacgcggttctaaatcttgtttttcaataccttcagcgatcatatcgacaaatttaaaatcgaaatcaggtaattctgctttcattttttctgcaagctgttttgctcgaacgcaataagggcaacttaatctgccgtaaatttctacaaacatttttaatctcctataaattattaggggcattgttgcccctacttctcattacttcgtgctggtacttgtcgtggtacgacttgcacgtttacgttctacttcagtgagtaattttttacgaatacgcactgattttggtgttacttccactaactcatcatcatcaataaattctaacgcttgttccaagctgaatttaactggcgttgttaaggttaaagcatcatctttacctgacgcacgcatattggtgagttttttcccttcaagcgggtttacggttaggtcatttgaacggctatggataccgattacctgtccttcataaatttctgcaccgtgatcgatcattaatttaccacgatcttgtagtgcatagagcgagtaagcaagagctttacctgtgccgtttgaaatcaatacgccgttaatacgctgaccgatttcacctgcttttacatcgtcatagtggctgaaacttgagtaaagtaagcctgtgcctgatgtcatcgtcataaactcattacggaaaccgattaagccacggcttggaataatgtattctaaacgagtacgacctttaccatctgggatcatatcacgcacttcacctttacggataccaagcgcttccatcacagccccttgatgttgttcttcaatatcaatggtcacttgctcaaacggttcttgtttacgaccatcaatctctttgaaaattacttttggacgagataccgctaattcataaccttcacgacgcatattttcgattaatacagacaagtgcaattcaccacgacccgatacgctgaaaacatcagagtcatcagtttcttctacgcgtaatgcgacgttatgcactaactctttcttcaaacgctctaaaatttgtcgtgaagtaacgaatttaccttcttgaccgcagaagggtgatgtgtttacacagaagaacattgttactgtcggctcatcaacagataaagctggaagtgcttcaacattgttgatgtcacataaggtatctgaaatgtttaattcgcctaaacctgtaatagcaatgatgtcgccggcataggcttcggtggcttcatagcgttgtaagcctaagtgacctaacacttgaccaacacgaccattacgggttttaccttctgcatcaatcacggtcacaggttggttaggtttaaccgtaccacgtttgatacggccgataccgataacacctagatatttgctgtaatccaactgtgaaatttgcatttggaacggtgcatcaagttcaacatctggcggagaaacttgccctacaatcgcttcaaagagcggatccatatttggtgcaagatcttcgtgatccaaacctgcaacaccatttaatgcagaagcataaataattgggaaatctaattgttcgtctgtcgcaccaaggttcacgaataagtcgaatacttgatccaccacccagtcaggacgagcaccagggcggtcaactttattgataaccacgataggttttaaaccgtgagcaaacgctttttgcgttacgaaacgggtttgtggcattgggccgtcaaaggcatcgaccacaagtaataccgagtccaccattgaaagcacacgctcaacttcaccaccgaagtctgcgtgtcctggggtatctacgatattgatacgatagccgttccagttaattgcggtatttttcgcaagaatggtaatgccacgctctttctcaaggtcgttggagtccattacacgttcatctacatcaccacgagaggtatctaatgtgcctgaaagttttaataatttatcaaccagcgtggttttgccgtggtcaacgtgagcaatgattgcgatattacgcagtttttgagtatctaattgttgcattgaaataacttaattgtagggtggggcttacccaccgagaataaaaaatgatgagctaaagctcatctgacgaaatccaaaattgtgatgaagatcacaaaaagacgggcgattatacagaattttgattgaactgactagaaagcaagcggtttgtttgaagtaaaaatttgcaaattatttcgaataacttaccgcttgtatgaaaactcaggcttaaataggctataatccccacataattttatttattggagaatcgttatgcctttactagatagctttaaagtggatcacactcgtatgaacgctcctgcggtgcgtgttgcaaaaacaatgacaaccccgaagggcgatacgattactgtgtttgatttacgttttgtccgtccaaacattgagattttatcgcctcgtggtattcatacgatggaacatttatttgctggttttatgcgtgatcatctcaatagcgataccgttgaaattattgatatttcgccgatgggttgccgtacgggattttatatgtcgttaattggttcaccttcggctgaagaagtggcaaaagcttgggaagcctctatgcgtgatgcgttagagaaagtgcctgatgaaactaaaattcctgagttaaatgagtttcaatgtggttcatataaggaacattctcttgctgatgcacacgaaattgtgcataatgtgttaaaacaaccgattggtattaaccgtaacgaagatttagcattagatgagaaattgctaaatccatagttattggtacggaactaacaatagtttcttttcaaatggtagggggcacactgagtgtgtccactacattttattaccttgcaatttttacccaccatacttataaggagagcccgtgttaaataaattatttgattggtttgaaaatcgcattaatccttatccagaagatatgccgaatacgcctcgagcaaaggttattccttttatttttgaaagtaccaaaggaatgagaagctattttgtggcgttaatcatttttgttgcatttataggcattattgaagggattttgtttcagtatatgggcgagttggtggactgggtaaacacttattctgctcaacagttgtggcaagaaaaaggcacttctctgatattaatgctgattgtggcattgatgagtgtggtgtttgtctatctcggctgtgctgttcgctttcagtcgttacaaggggtatttccgatgcggttgcgttggaatttccaccgcttgatgctcggacaaagtatgagcttttatcaggacgagtttgctgggcgtgtatctgctaaggtgatgcaaacagcattagccgtgcgtgaggtgttgatgacctgtgcggatatgctggtctatgtgattgtgtatttgacgacaaccagtgtaattttgcttcagcttgatggctggctatttttgccttttattatttgggtagtcagtttggcaacgattatttggttatatgtgccaaaacttgttcaagcagctcaagagcaatccgatgctcgcagtttaatgacagggcgaattaccgacgcttattcaaacattgcgacagtgaagctgttttctcacggtaatcgagaatctcgctatgccaaagagtcgatggaagagtttatggtaacagtacataaacagatgcgtttagtgacaacgattgaaacattgaccaattttagtagtatcgcattaattacgatcaccgcaggtattgggctatggctttggacgttaggtgaagtgactgcaggggcaatcgccacttctactgctttggcgttacgcattaaaggtctatcacaatggattatgtgggagtttgctagcttatttgaaaacttaggcacagtacaagatggaatggaaaccttatccaagccaagaacaattgtagataaagcagaggcaaaaccgcttgaagtgacacaaggtgaaatccgatttaatcaggttgattttgcctataatgcgaaaaagcctctactgaaaggctttgatttacatattaaagcaggtgaaaaagtaggtttagtggggcgcagtggggcaggaaaatcgactttaacgaatttattgttacgtttttatgatgtgcaaaaaggttcagtggaaattgatgggcaaaacatttgtgatgtaacgcaagaaagcctacgctcgcaaattggtttagtgacccaagacacctcattattacatcgttccgttcgagataatttgctttatggtcgtccaacggcgacagaaacagaaatgcttaaagccgttgagcgagcctctgcctctgattttattccgcttctcagtgatgctaaaggcagaacaggctatgatgcacacgtcggcgaacgaggcgtgaaactctcaggcggacaacgtcaacgtattgcgattgctcgtgtgatgttgaaagacgcaccgattttattattagatgaagcaaccagtgccttagactctgaagtggaagtcgctattcaagaaaatttgaccgaattaatggaagggaaaactgtcgttgccattgcacaccgtttatcgaccattatggcaatggatcgcttgattgtattagataaaggcgaaattgttgagcaaggtagtcacgaggaattattagctctcaatggtgtctatgcaaaactgtgggctcatcaaagtggtgggttcttgcaggaattacaggacgatatataagatagaagaactatttaaatcaaagagttggtaagaatcaggaatataattattaccaactttttgttttacagccctatggggttattcatactcttctaaccaaatcgttaaaatcgcttccaagatatgttcatttgacgcttctggatcatcctcaaaatcttccatctcacagatccatttatgcatatcagtaaaacgcacggtggttggatctaaatctgggttcatatcatacagattttctgcgatcattcttacatcagtccatttcattagtgtgctgcctcatttgcgtggtttaagttatattttggaatttcaacaacgagatcttcttcacccacaatacattgacaagacaagcggctgtcgatttctaagccccacgctttgtctaacatatcttcttcttgatctgatgtttcatttaagctgtcaaaaccttcacgaattacaacgtgacaagtagtgcaagcacaagaacagtcacaagcgtgatgaatttcaactcctgcattgtgagcaacttctaataagttttcacccgcttgagcttcaacaaccataccctctgggcaaaattcttcgtgtggaagaaaaacaatttttggcataatgtcctctaatatcttctgtttatttgtagggacacactgcgtgtgtccgttatttattttgcggacacacgcagtgtgtccctactggattttatcccatcacctcatcaaccgccttacctgctaaggctttttgaatggataaattcattcgtctagcggcaaattcttgggtggcaatatcaagatctttaataccttgctggatagcttggcgatctgttccttgttttgcgtaaatcaatttctgtaattccgcttcaatccctttaaattcatcaaccgaaagtagctctgcaccatcttcttgcaacgcaatgacaacgctatcaatcacacgatctgcctccacacgctgttccgccagctgacgggcttccatatcttgcttcgcattcgtcattgacgatttaatcatttcggtgacttcttcgtccgtcaaaccgtaagacggcttaatttggatagacgcttgcactttggttgatttttccattgcggtgacactcagtaacccgtccgcatcgacttgataagtcacgcgaatgtgtgccgcaccagcgaccatcggtggaataccacgcaaggtaaaacgtccaagtgaacggcaatcatcgactaactcacgttcaccttgtacaacgtgaaccgtcatcgctgtctgcccatctttaaatgtggtgaactcttgtgcttttgccacaggaatagtggtattgcgaggaatgattttttccaccaatccgcccatcgtttcgatccctagcgaaagtggtacaacatctagcaacaacatttctgcatcaggcttattgccgactaaaatatccgcttgaatagctgcacccaacgccaccactttatcggggtcaatagaggttaatggcgttttgccgaaaaattcgcctacttgttcacgcacaaaaggtactctcgttgagccaccaaccatcacaacttcacgcacttcttgagcttctaccccagcatctttcaaggctcggcgacaagtcattaacgagcgttttacaagcggttggattagctcattaaattgcaaacggctgatttcaccctgccaatttgcaaattttgcagtaaaactgtccgcttgtgataagccaattttcacttgagtggcaagagtaagtagttcacgttgctgacttgctgtatttggctgaatacctgcttgttccgcaatccaattcgctaacagatgatcgaaatcatcgccacctaaagcggtatcgccacctgttgctaaaacttcaaatacacctcgacttaggcgtaaaatcgaaatatcaaaagtaccgccacctaagtcatatacagcaattacaccttcttgaccgctatccaagccataagcaatagccgcagccgttggctcatttaataaacgcaacacattgagccctgccaaacgagcggcatctttggtactttgacgttgtgcatcatcaaaataggcaggcacagtaatcaccacgccagccaattcacccgccaagcgtttttctgcaaattgatttaagtgacttaaaatatcggcagacacttcaatcgggcttttattgccttgtggcgtttgaattaacggcaagccgttatccgtcgcaacaaattgataaggcagatttggataacgctgttcaacatctgccaaagaacgaccaattaaacgctttacagaaatcactgtatgttgcggatcagctgctgcttgctcaaaggcttccacaccaacaactttattctcagccgcataatgtactactgacggcactaacgcacgctctttctcatcaagtaatacctgagcttgtccgctacgcaccgttgctactaaagaatttgtcgtcccaaggtcaatccccaccgccaagcgatgttggtgcggcgctgccgtttgccctggttctgcaatttgaagtaatgccattttattatctctctataactcattcccctcccccgtttacgggggagggctagggagggggggattgtccgttaggacaactacaagcggtttgattttgaaaaaattttgcaaacttcgtttgcccccatccgccttcggcaccttcccccgtaaacgggggaagggattatgttaattcaccgcataccccatatcatcaggcgcaaatgtcgcttgataatggcgttcaatcggttgtttttgttttgtgtctaaatttatcacttgattgccgtttaaatctgcaatctcagcttgccaattttcactacgcaggctgtggtaaaaaccagcaatatcggcagttaatgcccagccgataaattgtgaataatttaagccaatactctcccatttctgctttttcgggtggaaataatgaactaaaccgactttttcgcctaatccgccaccgttcaccgcaaaataaccaccaatggcatcatcagcaatcagtaaatgaaacggtctttcgcccgattgttcaaaggttttaccaaaattccactcaaacaaaccgcgtggcagtttctcattacccgaacctaaaatgcgtaaccagccgtgatcgactaaaataccgcccgtttcataaattaccgcacccagtggcgtacttgtcggtaactgcattcccaccaattctgcccctgcattttccacatctctcggcaggatttcataatggttattcgcttgcttgaaccaatcttgcataattggccaagcggatttttgtttatcgttcagctcttcgagggttttcatatttatttttctatgtagggacgccacgcgtggcgtccctactttcttttgtgcgaataccacacaattaaaattcaaacaacttctcttctactcgctcaatttttacttttttagtttcaatgtcgcttctaaaaaatgattaaaatcacttctgtaaatacgatcctgctttattctaaatttatcatattcctgttctgcttttaactttgccatttcgtgacttatttttcctttatctcgtaaaatcggataatttgataaagttaagaagctatctaaaaaagtttcccattctgccattgatgttaaaatttggcgagtagctctattctctgctaaatctaaataagctgaaaccaactgttctaactctttaatatgttgctcgcttaaataatttttagcaatactgacatcactctttaaaatttttccatccggtgcatttttccaagttgttaatcccatatttatagcttctgcatcggcttgtgtataaatcaactctgcagctgttttgcctgtaatcgcccaatgtaatttattttgaacagtggaaaaaaagcgttttgtatgggcggaagatttatcataatcactggctagagcataaatatcggtaattttctcgtaaaatcgtcgctcagaagctctaatttcacgaatacgttcaacaagattagtaaaataatctaaaccaaactgtttaccttgtttcaaacgctcatcatcaagtacaaaaccttttaaaataaattcacgtaaaacttgagttgcccaaattcgaaattgtgttgcttcccgactgtttacacgatatccgacagcaataattgcatctaaattataaacattcgtcaaacgagtaacttggcgatgaccttcttgttgaactatttccattttggaaatggttgaaaattgaacaagttcccctgtgctatagatattatctaagtgtttagaaatagccggaacatcaacaccaaacaactcagccatacttttttgagaaagccaaaaagtctcatcttggtaaaagacattcacttttactgattcatcaggtgttgtatagaataatatattcgcactcgttggaatctgtaagttagacatgttaattcactcgtcaaataatcggatattttaattatggcgaatctgccataattaaaactcaaacaacttctcttctactcgttcaatttctaccaataattttttaataaaacgaagtttgtcgttaatggctagtgcatccgcccattgttgtgcattaagagcttgctcaagtttttgtaaaatggctttttgctgttgttcaatctcttgggcgaaagcggtgagatccgcttcgttttttgtggtttcaatgctttctaaggtttcacgccattccatttgttgcattaaaaacgccatatctcggttacttttttgctcaatatcttgctgttcacccgtatgaatagcaatgatcgcttcagcacgcaaaatcggatctttgagaatatgtaacgcatcattaatttccgccgatttctgcattgctaaacgctgttctgtcgcagaacttgccgcaaaattatcggggtgaagcgatttttgtaaggctaaataacgctcagacagttgagcattatctaattggaattgcacaggcagatcaaaaagcgtaaatggatttgacatcagaacctcttagacgttaaaactttcaccacaaccacattcattcttcacatttgggttgttgtacttaaatccttcgtttaatccttctttgacaaaatctaattctgtgccactgaggtaaacaaggcttttttcatctacaataattttaacaccgtgttgttcaaaaacgtgatcatcttcgtttaatacatcaacaaattcaaggacataagctaaccctgaacagcccgatgttttgacacccagccttaaaccgatgcctttgccacggttttcaaggaaggtacgaacacgatctgctgcggtttctgttagggtgatgctcattttttctccttgtgaatatagttaattttaaaaagatctcattcccctctttagtaaagaggggttaggggagatttgtcaaacgaataaacgaagtgagagataattcagaacagagttactgttatttgggaataaacaatttatattcttcgttctttacttctgccaaatctcccccagcccctctttgctaaagaggggagcagagcgaagtaaattttctttcattcgtctgatacaataaaacctttttaaaattaacaataaacgaaaacacaagcggtcagattttgcaaattttttgcaaaaactaaccgcttgttagagattacttaccgtttttctctttgtaatctgcaatcgctgctttaattgcatcttctgcaagaattgagcagtgtacttttactggtggtaattcaagctcttctgcgatgtcgctgtttttgattgcttgagcttcatctaatgatttgccttttacccattcagtaattaatgagcttgatgcaatcgctgaaccgcaaccgtaagttttgaaacgagcatcttcaatgataccttgtttgttcactttaatttgaagttgcattacgtcaccacacgctggtgcgcccaccatacctgtaccgatatctgatgcttttttgtcgaatgaacctacgttacgtgggttttcatagtgatcaataactttatcgctgtatgccattttttaattcctctatgttaattattcccccctttgcaaaaggggggctaggggggattttgcaagatcgttaaatccccctcaatccccctttttcaaagggggaagtttctattaatgatgcgaccactcaattgagtttaagtcgataccttctttgaacatatcccaaagtggtgaaagttcacgtaattttgttactgcttttttcacgatttcgatagtgtgatcgatctcttcttccgttgtccaacgaccgattgagaaacggattgagctatgtgctaattcatcgtttaagcctaatgcacgaagtacataagatggctctaaacttgcagaagtacaagcagaacctgaagataccgcaatgtcttttaatgacatcatcattgactcgccttcaacaaagttaaagctgatgttcaagttgctatctacacgtttacctgcttccatcgtaccgttcacatacacttcatccatatctttgaaaccgttaaataaacggtcacgaagtgctttgatgcgtggtatttcagttaccatttcttcttttgcgatacgatatgcttcacccatacccacgatttggtgaacaggtaatgtacctgaacgcataccacgctcgtggccaccaccgtgaataatcgcttctaaacgtacacgaggcttacggcaaacatataaaccgccgataccttttggcccgtaaagtttatgacttgagaaagacattaaatctacgtttaatgcttgaacgtccacagggattttacccactgattgtgttgcatccacgtggaaaatgatttttttcgcacggcagattttaccgatctcttcgattggttgaataacaccgatctcattgttcacatgcattacggaaactaaaattgtgtctggacgaattgcagcttcgaattttgcaatatccactaaacctgttgtttcaggctctaaataagtgacttcaaaaccttcacgctctaactgacggcacgtatctaatacggctttatgttcagttttaacagtgatgatgtgtttacctttggtttggtagaaacgtgctgcacctttaattgccaggttgtcagactcggttgcacctgaagtaaatacgatttcacgagcatctgcaccgattaaatcagcgatttgattacgagctacatcaaccgcttcttctgcttcccaaccaaatttgtgagaacgagatgcagggttaccaaacacgccgtcctttgtcatatattccatcattttttttgcaacacgctcatcaacgggcgtagttgctgcgtagtccaaataaattggtaatttcattgttactcctaactaagagatttttataagattaatggtgatgatcgtggcagtgagaagtctcacaatcgtgatcgctattttcttcaactaattcggctaaagttatcgtatgtaaatactgttcgatttgattttctaaacgctcccacagcgaatgggttaaacaacgactgttattactgcaatttccatttcctttacatttagatacatcaacactctcatttacagcggcaataatcattcccacattgatttcttcaacagattttcctaattggtagccaccgccaggacctctcacgctatgcacaagaccttctcggcgaagttgtgcaaaaagttgctctaaataagaaagtgaaatggcttggcgatctgaaatatctgccaaactcactggcatatctttgccatgcaacgcaatatctaaaattgcagttacagcataacgtcctcgtgaagttaatttcatactcaaactttttaaaaatgctcgattgttaggaaagaattctatataccctactaatttagtcaatatttttacacaaattaaatcaaaaggtttttttaatcaatttgctaatcttattcacataaacattattttaaagtttagataaaacactaagcggcgaaattctaaactatttttataaccatagttaaaatcccaccgcttacgtcaagattacaaagttagcaactatttgtaatcatattgataataatcataacgattagaagccttacgttttataccattcaaaataaaacctttaataaagacccctgcacgttcaaaacgttctttagctaatccaacttctttaagtgtagtttcaccaaaacgcccaacaagtaaagatgttcccgcatacctaccaataatagctgcatctgtaacagccaaaataggcgctgtatccactatcactaaatcatattcttttgctgcccattctaatagtgcctgaaaacgagcattagatagtaattcagatggatttggtggagtttctcctttaacaataatatcaaaattatcataatgttgaatcacttgttcaaaaggaatttgctgtgcaatcacatcactcaatccaacctcttttgctaaacctaataatcgacgcaaataactccttcttaaatctgcatcaattaacaacactttatgcccagctttagcaagaacattagccaaattggttgaaataaaactttttcccacagacggagaagctccagaaatcattaatatattatttttagcttctaacattgtaaaatgcaaacttgtacgcaaactacgcaaagcctcaactgctggatctgtaggcgttgactccgacaataattcaaaacgctgaaccttatgcttagaaaaaataggctgttcatttgaatatggaatcgtagcatacgttggcaagcctaacacatctaattcagatgttccctcaatacctctatgtagtagcgttttcgctatcgcagtaattgaggcaaagataagtcctaacataaatgccaaggcaaccacaatcatttttctaggtgaaacggcattaggaaaaacttgcgcctcgtctaaaatacgaacatttcctatcgcactagccttaacaatttctaactcttgcattttattcaacaattgaatataaatttgctggctaacctccaaatctcgagttaaccgaataacctctttttgagtagtaggtaaacgttctacttgtttatttaaacgaattttttcctcatttaatactttacgcttatcaatcaaagcaacataagcagggtgatttcgagtgaacttttgagaaatttcactctcctttaatgttaactcatttaaatctgcttctaactgaactatagtatctaatgctgatttagcttctagactgagatctactgattcattttttaagcggaattcattcaaattattctcagactctgacaaacgagctttaatttctggtaattgtttagacaaaaactctaaactcttagacgcttctgcagaattacgaacaatattttgcagcaaataattttcagatacactctttactatcttcttaatttgagctttattctctccattaatagaaatttcaataatgcctgtttgcttaccactatctgttaccgaaatttgtttttgtaaagtgctaattgctaacaacacatcattctttttaattttaaataattgtcctggcttagcctctaattcagaaatctcaaacgaaaaatcttccgtttgatactttttcccaatgctcccttcaagaactttttcatctgcaaaaaataatgagaactctccagcattctccccgacctctaaaatcacctctttcatctgaggattcttaggctcaaataaagagaccgacaattgtggttcatatcccatcaaacgatgaatacctttactaagaaaagggatcgagaattgaggttcaactaccgtagttaaattaagttgctcaacagtattggataaaaccattcttgattttagaattgcaatttcagtacttgaagatgatttaccctctaaaattcctgcgaaatcttttaaccccccccctgaagatttactttctacttgaattgaagcattcgcagtgtaaacaggcgtagctagtaaaacataagcaacaccaaataacgtcaccaacaatgtaaaaatagctatccaccacttataatctaataaagcccccaacaactttactaaatcaatttcatcatgattattttcattcatcttttaactgccttaaaattagagtttcaatttccatctcaatgctgcatcctcaatcaatgcataaacctctcggaacatatcttcactttgacgataaggatctggaatatctttattgctatccaaccaatgaccaaataacatgacttttccagaactttctggtgaaatttgtcgaaccaagtcaatatgacctttttccatgacaagaatcaagtctacattcttacatagttcagacgttaattgctgtgaacgatgttcagaaagatccactccacgagaaatagcaacttgttgcattgttggatctacaccttttccaactaaatggctacgctcagctgaaatacctgctgaaaaaatacgcttttcaggaaaatattgttttaataatttttctccgacgggggagcggcatatattaccgatacaaacaactaaaatacttccaaacattaattaccaattcctcactcttaatatagactctgttagattattgaaaccagataatgacggaacaacatgggcaatcactctattccaacgagttgctggcgctgttgtcacataaacaatgtcataaggttttaaataaaactctgttcctaatacataggaagttgcattagtcaaatccaattgataaatatctgcaatcttatctgttttttcagcttcatttgaaaccgttgacttatttacatcacgttgaccacgaataacaaaaatacccgttgcatctgcagataatttatcaattcccccactctgagcaattgcttcggttaacgtcataccataatgagtaattttcaacatctgaggttttgacacttcccccacaataaacaccttattcgcatcattgcgtggaatatgaaccacatcgccatcagataacaaacgattctgcgttaaattaccaaattgaatcaattctgctaaagagactttctcctctttaccatgacgagtaatagtcacattatgccaatccgcattatcagacaatcctccagccttatttacagcatctaacaaggtgagcggaatattagttaaaaattgctgtcctggattcttgatttcgcctgttatatatgcttttttagattggtatgaggcaattgttacctcaacttgaggatctgtgacataggctgaaagagcttttgccaatttatcacgaacttgatttactgttaagccaacaacattaagctgcccaacatatggataaaaaatagttccattagcatgcacttgattacctgattcagcggcagaacgataagcacccgcaggagttgtcaattcaggatgatcccaaactgtgacatttaatatgtcgccaacacctatcttatattgataacgcttaatttgttgttctaaaccaatgttatcacttgctttcaccgcacgaggagctaactgctttactaactgaggcgtaattaaataagcatccacaaccttctcaaagtccacattctctcccctcacttccgtatcaacaataggagaatgcgttgcaggtaaaatcatcccacaaccagaaagagataaaatcacaccagtaaaaacaagagctttagttaacttacacataatccatcctactcattttataattaacaaaatccatcagaatagctcaaaactcacacaccaaacgtcgaattgaacttaataaacatcgttccagtatacaacaaaccacatttatttgcacagaaaaactcgaaaagaaatatcgatttgacacacacattttgaggtgtaataaatcttcactattctactatgccttctactacccaattcttattctcactgaatatatcaaaaaggaataggctaatctaaatatactatttatctacttgcatccgccaaacaaaatccactattttacttaccggagtatacccaattagagaattcaacaaaatatcacgaatcttatcgcattgattatcttgacaagctaactctaattcttcaagtaaagctagcaattcatttaacggcaaaaaatcttcttttgcagtcataatacgatgatgtgcggttgtttctacattatcgcctgcaatcaataactcttcataaagtttctctcctgatctaatcccagtaaacttaatctcaatatcaccagttggattatcttgatttttcacctctaagccagataagcgaattaaatttaccgctaaatcaacaatcttaacaggctcccccatatctaaaataaatacatcgccaccttttgccattgctcctgcttgaataactaattgagctgcttctggaattgtcataaagtaacgaataatatttggatctgtgaccgtaatcggaccgccttggcgaatttgctctttaaatagcggaataacggaacctgatgaacctaaaacattaccaaaacgaaccatagagaaaagtgtgttatgttcaacaccgtctaagctgtttctcttttccatagccaatgcttgcaaacacaattcagcactgcgtttagttgcgcccattacgttagtaggacgcactgccttatccgttgaaatcaatacaaaagagttaacttgagcttcaatcgccgcctgcgcagtataataagtaccaaaaatattatttcgcacaccttcaactacattatactcaaccattggaacgtgtttgtaagctgccgcgtgatataccgtatccacttgataaacccgcataatttcaactaaacgtttaaagttctgaacgctccctaagagtggaataatttcaatatgacctaactgctgagttttaacaatatcgtttaattccctttcaattgcatacaatccgtattccgaaatctcaaataaaagcaatttacgaggttgattacgaataatctgacgacaaagttccgaaccaatagaaccaccagcaccagttaccatcacaatttgctgttgaatatttttactgaataattcaggaattggcgccacaggctctcgacctaataagtcaataatattaatttctttaatatcactaatagaaactttcccatcaacaatttgagttaattccggaatttccataatttttactttagcgtcagataaaaacttcacaatctcattttttctagcacgttcaacggatgacaaagcaataatgacttgatcaatctgataacgttgaaatttctcaagcgcattctgagcagaaaacacttttagacgccctaagcgagtattcaccaaattctcattatcatcaataaaaaagataggcaaatgctcgtgagaacgaagcaacaacacagccaattgctgccctgcagatcctgtaccataaattgcaattcgcttacgcggagtatccgcttgtaaggcgtttttaaccaaagctctaataacacctcgactcaaatatacccaagcaaacataaaaaagccaaacatcaaaggaattgatgtcggaataaccgctggagtgctatcgcctaacaaaaatagtgcaataacagtgatcaacgttgcaatagaaagccggaaaattaacgtttcagagaatgtgtgaataacaaagtgataaaccccacaaatggctaaactcgctacagcgataattgaaactaaaatttcaccataaggcaaatttgggataacttctgcatttaaatcaaagagacgtaaggcatagactccccaaatcaaaataggaaatatcgtaaaatcaaacaaaactaaacctatttgcttaatattccttggcaaaaaggttaaatgtgttaaaagttcctgaaacatattaaccttctgaaagttgtttaatcacatttctaataacatctatagttttatttaaattctcttcagttaaggtaggatgaaccaagaacattaaactcgtttcacctaattttttcgcattttctaaacgccgttcaggtctccaaggcgtattatcaaatgctttttctaggtacacctctgaacaagagccactataacaaggtgtacctaactcattaatcacattcataatacgatctctatcccagccttgtggtaacgcatcactatttacttgaacataacatttataagccgcatgaatgtagtcttccgatgggcgattcacagtaaaataaggacagttatcaaaagcagataaaatcaattccatattctgattacgtatcttcgtccattctggcatacgttttaattgaatacgtccaatcacagcttgaacttccatcatacgccagttagtaccaaaagagtcgtgaacccaacggaaacctggaggatgttgcttattatagacagaatcaaaactctttccgtgatctttataagaccacattttatcccataaggctttatcatttgttgtaaccataccgccttcaccacctgttgtcataattttatcttggcaaaaagaccaagcaccaatatgaccaatagaaccagcagaacgtcctttatacattgcaccgtgagcttgggcacaatcttcaattacatataagcccttttcttcagcaagagccatgatcggatccatatcacacattaaaccagctaaatgtacacaaataattgccttagtattgggggtaaggactgcctcaatcgttctacgagagatattttgcgaatctaactcaacatctgcaaaaataggattagcacccgctgttacaatcgcacttgctgatgctaaaaaggtacgagaagtgacaataacatcatcaccgataccaatacctaatgcttttaacgcaacatccaatgcaacagtcccattagttaaagagatggcatatttagtttgagcaaattccgcaaattctttttcaaattcacgacattctgtaccagtccaataattcactttatttgataaaatagttttagatactgcatcagcttcttcttgagtgaaagagggccaaggggcgtagtttatatttaacatatcaactccaatattattctaaggaatgaaaatttcagcttctccagagatcacaattttattacgaacagtacaaattgttgaaaataaaactattcttctttttatatcaatagatataatttgaacctttgctgtcacagtatcacctagataaacaggtcttttaaattgtaaagactgagaagcataaacacagccttgccctggtaatctagtaccaaataattgagaaaaaaagctagctgaaatcaacccatgcgcaatacgttttttaaacctagattgttgcgcatattcttcactaacatgtacgggattatgatctcctgatattccagcaaaagcttttatatccgtatcggtaattgtttgtgaataagtcgcatacatcccaattctcaatttatcaataggaattgagtttactatttcttgatttgtttccatataacataagacctatttattttttgaaaattctcttagcgatctagcaggatttcccattaatacagcaccttcaggaacacttttcataacaacagcccccatacctataacagcccctttaccgataactaaaggtttttttgaagttccttgcttaatgatagcacctgtacctatatatacattgtcttcaatatgaacattgccattacatttaactcctggagcaaaggtaacataatcaccaataatacaatcatgagcaacatagctataaatattggcttggaatcctctccctattttgatattacttgttaaacaagtaaaaggacataaaatactgccatctccaatttctacattatcaagaattatggaatttacagcttttataaataattgccttatgccatccgtactaagtttctcagatattgtttttcttatttttccatcagcaatagcgattacgacagattttattttatcaggtatgccaataaattcctcataagagatcacattaatatcatttaaaataaatccagctaaagaatcatcaataaatacaatattatcccgagataattctggatattgcattctaaccaaaggcaaaacctctttaccaaatccacttgcaccataaatacctataatcatttttactccttactgtttgttcccataaattttgacatagtagtttcaccttcagcattaatatcttctttaaaaaagactttctttaccgttttaaataaaatctgaatatctaaccaaaaggactgattttctacataccaagtgtccaattcaaacttttgctcccaactaatcgcattacgtccattaacctgagcatatccagtaatccctggacgaacattatgtcgttttgcttgttgctcattataaagtggcaaatattccattaataaaggacgtggcccgactaaactcatatccccttttaaaacattccataattcaggtaattcatctaaacttgtagctcgaagcattttcccaaacggtgtcaaacgctctgaatcaggcaaaggaatgccatccttatctacagaatctttcatcgttctaaacttaatcatttcaaatggcttaccatttaatccagggcggatttgtcggaatagtactggtgagccaagattttttttgactttataagctactattaaataaactggaaataacaaaatgagaataaatacagatacaatcatatcaaatacacgttttaacatatgcttttatgattcctaaatattaaaacagattattatataactttataaaaaacgtctataaactttttagttccttcttgaatagaaagtttagctgcataaaatgcttttgcattttttgctaacctagcctgttcctctttggacaaggaataaatatcaatgatagctttagaaatacttaaaatatcttcaggtatagcaactttaccgcagtctgaattaataactaaatctgcagcatccccttccaccgccataattattggttttcctatagacatataagcttgagtttttgatggaactgtaatcttaaaaagttcatctttctttaaatgaactaataaagcatctgaggcttgtaagatagcaccaacttcactcattggttgttgtggaataaaaataatattcttaatattttcatttataaccctctcttttaatctttccgtttcagttcctttaccaaccatgacaaactgaattctaggataggactcatttaaatttttagctacatcaattattgaatctaacgcttgagcttttcccatattccctgcaaacacaatattaaatttgttttccatcagttgtttgaattgagattttaattctgaaaatgaatctaatgcattttcattacaccaattataaataaccgtaattttattactaggcacatttctcttaattaaaattttttcaaaacctggacttagtacaacaatatgatcaacatatttgtatactgtatgacaaactatattaataatactaaggattttatcattattgatcatgcctgttgctttgagagtatctggccataaatcttgtatatcataaataacaggtatttttctaaagaatttaataataattgccacaacacctactgttaaaggtggatggtatgtataaatcacatccgattttttagtaaaaaaaataccaaatattattgccattaatgcaaaactaatataattaaaaattctccttaatgaagaattatcgtggctaggatacaatggaactcttaaaatagagataccatcaatattttctttttgaaagaattttagttgatatccttcatagattttccccccaggataattaggaaatccagtaagtacttgcacttgatgtccttgcttctgcagctcttttgcgaaagcaagtcctttaaaagttggttcagggtcaaaccattgagtaagtagtaaaactttcattaatattttttccacacaacacgatttacataatcggtataacttaaaataatacgaacaaccttctcacttacatttggcatactataatcatcaactagaagtaatgttctcacctctcctcttgattgagattccaaaatatttaatccttgcaatactctatcagttgtcagcccaaccatcattactgcagcttcttccataccttctggccgttcgtgagcttggcgtaaattcaatgcggggaaatttagaatagaagcttcttcattaatggttccactatctgataaagttgctttagctgacagctgtaacttattatagtcactgaaacccagtggttttaacagctgtactagtgggtgaaacttaacccccatttcctcaactctcttgcgagtacgagggtgagtagatacaataacaggatatttatacttctctgcaacggcatttaacatttcaactaaatctaaaaaattcttgtctgaatttatgttctcttctcgatgtgcactaacaacaaaatattcattttcttttaaatttaatcttgttaaaacatctgaagcataaattttatctttataataatttagcacttcaaacattggactccctgttttaattacttgatcaggtctaagtccttccgccagtaaataatctctcgcaatagagctatatgttaaattaatatctgcagtatgatctacgattctacgattaatttcttctggaacacgcatatcaaaacaacggttcccagcttccatatgaaatgttggaatcttacgacgtttagctggtaatacggacatacaactgtttgtatcgcctaagacaagtagcgcatcaggatttacttgttctaaaatttgatctactgaaataataacttttcctattgtttcagctccggtagaacctgcagcatttaaaaaatagtctggctttctaataccaagatcagcaaaaaagatttcattcagctcatagtcataattttgacctgtatggactaaaatatgttcaaaatatttatcacacgctgtcattaccctagacaaacgaataatttcaggtcgcgtaccaaccacagttattaattttaattttttcatacatttttctcttcatcattgagttaaaggcataaaataagtgtcgggcttttctctatcgaaaatttcatttgcccataacattacaaccatctcttcattgccaatattagtaatatcatgcgaccacccaggaaccgtttctacaattcttggttcatcgccatttgtctctaattgataatattctccagttacaatatgcttaaatttaaataaagctttcccttttattaccaaaaacttctcattttttgaatgatggtaatgcccacccctcgtaatacctgggtatgcagtaaaataagaaaattgacctgctgatggtgtttttagcatttcaacaaaaactcctctctcatcgctatatttaggcactgagtaatcgaaatgatctggagtaaaaaagcttaagtaagtcgaatataaagctcgttttaaccctacacctacttcatctgttactaatgattgtcttgagtgcttaaatgaagctaaaatttcaactaactcactaactgtcaccttatattcaggttcaacttgataaatgcctgtaggttgatataaaccttgaataatattccaaaaacattctacaacatcatcaatatacaccaatctaattacggcattcggatcgtggatttcaataggtaaattgtgtactgtattataacagaatgtagcaacagcagaattatagttaggcttagaccatttaccgaaaacattagctaaacgacaaatatatataggattaccgtttaatttagataagttagaaataatatcctcaccagctaatttacttcttccataagcattatctctttcagcttgaatagatgaagataaaataagcggtgtttttttattatttttttgcaaaaatttagctattttttgagttaattcaatattaccctcgataaattcttgctcatttttaggacgattaattccagctaaatgaactatccaatcagcctctaacaacatagaattaagttcttcttctgacgactgacgattaaatagcattatctcaatatcatttttttcagaaagatattggattaaatttttggcaataaaaccatttgagcctgtaactaatactttcatattattcctctggagaaatatattcacctttaatcattgagcgaataaattctagtttcaaaagtaattttttcattccttcaacatctaaacgctctgtattatgcgaattataatctgtcacttcagaaattcttagatttcccgtttcaacatatttaccataatttagatctcgctgatctgctgggactctgaaataataaccttggtcgattgcgtgaagcatttcttctctacttaataaagcttcaaatgctttctctccgtgacgtgttccgataatgtcaatcggatgatttggtacagaaagtaactctgtgatagcttttgctaaagttgcgatagttgcagcaggagctttttgaacaaaaatatcaccattctggccattttcaaaagcatatagcacaagatctactgcatcatctaacgtcatcataaagcgagtcatctcaggatccgtgacagtaaatgccttaccttgacgaatttgatctacaaataacgggataacagatcctctagaggccattacattaccataacgggtacaacaaatagttgtccctgttccctctaaattacgagatttagctacaataactttttccatcattgccttagaaatacccatagcattgattggatacacggctttatccgtacttaaacaaacaactctctctactctattttgaattgccgcttcaagtacattctcagtacctaatatattagtcttaacagcttccataggataaaattcacaggatggaacctgttttaaggctgcggcatggtaaatataatcaacaccacgagtcgcatttaatatactattataatcgcgtacatcacctatataaaactttagcttaggtgagttatattttttacgcatatcatcttgctttttctcatctcgagaaaaaatacggatttctttaatatctgtttgtaaaaaacgctttagaacagcattaccgaatgaacctgtcccaccagtgattaataaaactttattcttcataatatgtacctaatattattttaatttattaaacctttttgaaaaaagaaataaaaaagataaaaagaaatatccattcataccaagaatcatcccttttgaattaaaaataagagctagattaaaccataataaagcatataacttattttcaaatataaggattgataataaaaatacaaatagtagaaacaataggataaagactacaccaccataaaaaaacattataatccatcctgagtcatgagttatagttgcaacaccaacattgcttgccacattttcttggtaaccaaaaaggaaagtgaagatgtcaatatatctgccttcaaatatatttgtattcatcaatatactggcggtcctagttccattacttccaatgaactcataataaaatctaggcatgaaattctttaaagtttcaagtaaagaatcattaaaaatcataataatagaagatagtaaaataaaaataaagattttaaaaataaattttgacctgcccaaaaataatacagcgcaaataaaagaaataatagccatattagagtttatgacttgagtgattacaacaattaatttaagtaaaatcctcttttctatcaaaataaacgtcatatatattaataaagaaggagtcataaaattaatttctgatgacagaccaaatcctctaactgttaaattatggtcatacaagttaacttttcctaaagcaaatgtgttatataaagctatcttcaaatctggggatagaaacattattatgaaaaataccagttgaatatataaagaccatttaaaaagggtatcaaataaataatggtttgattttaaataaaatttatatattaaataagcaggtaaaaaagaaaggaaaatcattgaaataatcctaatgctaaacaaagagttaattttaaattctttttctcctatttgataaagatctaatactatagtatagataaacataaatactaatagtaacaataaagatgtttcttttttattaaataatatttttttattaaggtttgtcaaaaatgtaataaatcctattaagcctagaataaatgataaatatatatactcatgaaataaggatattctgaaaaaagtaacaaaaaaacaaaacaatgctattaaattggatatgtgtgagtgagttcgaacaagtttcatactatttataccagttttctttcaattcattcaaatctttattgcctctatctataattccatggatatatgaggataatattatatatctatataaaaaattaaaatgataaaattttactttatctgttaataaaaggaatttaatgatgaaatttctaaaaatggggctaaataaagtgtataggcctaaagatttcaaaatcgggctagaaaaaacatattctattaatcttagtttggtttttccaatataaactctatctttatagatttttttcataaccttcattccatctctagatgcatgataaattttatttgcgtatttatttatatctccaccaaactcataatgcataatgcattgttccccttgaataatatcaaaatttttatcgactaatttaaacccataatcatgatcttcagccccatatccaataaaattttcatcaaaagataattgattatgaataatctgctccttagaaataataaaattcattgctacaaacccccattgatcaagtctctttcctacttgagacttaggatggcgagaatctctatatctataataattactggagtttatttgttctggaagaaatctaacctctccacagaatacaatttttttatttaattgaggtaaataagacatacagcactctaaaaaagtagaggttggcacacaatcatcatctaaaaaaataatatattttccttcagaaaattttagcccataatttcttttacttgcaagtacattttctgtatggacatgctctatttttaaagaatttgatttttctttccacttatcacaaatataagttattttgtcactactatgactatctgctactattacttgaacaacgatattcaatttaaaagcctgttcactcaaactctttaaaattaaatctaactctttatctcttttccaagtcggtataataactgaaaacaacattaaaaattttccttattatgaagtataattaatatattaaatatcaatgaccaagtttatttattattttatcaactatgctcttgttactatctgtatcgttagataaaaataatgaagacattttttttcttcgctccttacctaatctatcatcaacaaataccttcaggatctctctaaagagttctgaaaaagaatttactctatttccagccagaacagaatcataatcaaaatacatctctctcccctgaagatattcatctagatcgaaagaaaagaaaattataggtctatctacaatcaaataatctagatatatagacgaataatccgtaattaagcaatcggcaatagctaataatttcataggatcttgtttattatctatcaatcgaatattattatactttgaaaaatcaacagataattttgtagcagaatgaagcttaaccaaaaatatagaattattctctttcattaaattatcaagtagttcaaaattgatctctgacttctttataaaatcatatgagttatctctccaggttggagtgtataaaaatactttttgaaatattgaatattctaatttatctttatttttcatttctaacattaaactttttaagtagctaactctaggatattgagctagaataatattatcatcatttattctaaatgcagattttaaagaataatcagcaatatatttagtgggagagattaaaaaatcattacgttggtaaatctgaggtcttaataccttggatataaagcttgcatctttaaacactttatttaatggaggtgtattaatatcaaactctatcttttttaatggtatcccatgccaaagatttacttttattgctcctcttgatgtaaaataattaatatcagacacatagcaagaaaatatatatacttttgctattaaagtataatataatccatttatacttaatgcgtgataggccttcccgtattttgaagcttcaattatagattgcttattattagaaatccaaatagcttttatattatgtttattagctttaataacatattcatacaaataacgactattatcattaaaaatgccaaaacttccaaatacccaaatacattttttgcgaggaataaaacctgaaatataatataaaggatatcctaaaattactctagatagagcatgaaatgctctataaatccaaatgattttattcctcatataatttcctcttatgttatcagtacaacacattaaagctttttaaaacatatgttggactaatatcagaaacttctaacatgtctcgtgtcgtgtctccagataatactaacactgaatcaatagcaaaatttttagccattaatatatctgtgtataatctatccccgatcatcagcatatcagatttatctatatttagttctttagcaacaagttcaaccatactgatatcgggtttcccaaaaattttcaatggagccacttttgtggtcatttctagcatttggataaaagatccaatatcaggaattggtccaaattctgttggacagaatatatctttatgagttgcaatataatcaattcctttattgattaatttacttgctgtaataagttttgaataggttaattcagtatcataaccaataacaactatttctgcatcatcttctgaaagcttgaagccattttcaataagactttgtttaagtttttctgttcctaatacataaactctttttatttctttctcagatagaaatcttagagttgcgtcggttgaaagaatgatgtcttttacattacactgtatgcccaattcatttaatcgactaacataatcctgtttggatttagaagaattatttgataagaacttaactatttttccttgcttttgtaacagcctcactgaatctattgcttcattaataacattttttcccacatataacgtaccatctaaatcaaataaatagcatttataatcagtaatctttctattcaattgtgagaagtacatatcagctaatgctaaatcatcacaattatcaatttcaacccatttatacttagaaatatttaatacgctaaataaaacatcttttctttggaaaattctttgtaaagcaacttcggtccaatttttgcggtttccttcttcaattgtttctgtgatctctttaaataaaagagtggatatttgatgagaaattttatagaaatcaatagaacatcctacagctcgatcctgaggtatttttttcgaaatgtctcttatatatccctcagaatcacaaataattttcattgattcatcattatataatccgacatctactgctactaaattgtcttctttagctgccagcatattagcaataatttccttttcaattactagatctgcattatttaatataaaaggttctccttgtaggtgttcttttgctaaatataaagaatacatattatttgtttcctcatattcttcatttttaataatcgtgatattaagatcatttatgtaacggcaataacgctcaatatgttcgcctttgtaaccaatgacaatcacaatatctttaataccagccattcgataagcatctaattgatactccagcattggcttccctgaaactttaactaaacactttggtttatcatctgtcattggtcttaatcttgagccaatgcctgctgctaaaattacacctttcatttaaaaactcctttagtattggatacagattaaaagactagttatatatattttacatttctaagaaagaaaataatcaaaaatattctacataaaagaataaaactctcagtgaaaataaccattaacaatacatttttcatatttacttgatttaaaataatcaatataaataatcctgatagatgaagtagcccaccaataacaacagtataattcgcccattttactctttttattgctgaaaaagcgggatatcccatattaaaagatacaaatgtaatacaagctaagaataagaattgttttactaattcatttgcagagagaaaatcattaccgaaaagtaacaaaataatttcctcaacgtataaactcaatatatagcacataaaacaaacaggtatactcaacaatccaacaaccatacataatagttttatatttcctgtttttaccatatatggatacatagtctgagctacaatcccaaaaactccattgacagctgaatatattttttctgcagcactatacaatccagcaatacttgtccctaaaaaatgccccaaaatcaatacatttacagtcgtatatacagaaactgaaatacgagaaataaaaaaagaaaaactatattttaactctctccaagatcccttaaatgtcggatttaacacaaaaaaaccatttttatatatattaattatgaataaaacagctacaatagtctgatttattaagaaacaaaaaaatacaacattgatatgttgataaagtgataatatgataaatactaaaatagtatatcctattttggcaataatattaacttttgtaataacgcccattctctcaattccttgaaagaaccaaatgcaatgaaatgcctgtgaaaatattgttatattaataaagataagtgctaataaatcaatcttatcagataattcaactaatatatacgcagttgttgctactgatacaataacagaaagaattaatttaatgaggaatatattacctaataacactcctattctttgtctatcattataatattgtgcaaccaaatgagttaccgaaatattaaacccaaaatcagtaaacatatatgcaagggttagtatagaaaaaacaatcatcactaaaccaaaattttcaactcctagaaattttgctaataaaggccaaattaataacggaaaaacataatttgagatttgtaaaatccctaaagaaacagcatttttaataagtttattattcaaaaattttttatgcatacattatttattctaactttattaaaatgagtaattctctgtctaaacccaagattaaaaaacattgattcaatctaaccattaattttaaaacaagcggtaagtcgagggctattctttgcagagaatgatttgatttttttatattctttccttacttgtagagattctcttaaaagagaatgaggatatttatatttatctcctttacatgcccccatcccccataaatgggggaagaatttttatcttcagactacattacttttttaatacttctcccgtttacgggggaaggtgcccgaagggcggatgggggaaatctctttgtatatttgtatacattcccctaatttcaatcacaactcatacaacccactcgtatcaaaactcaacgctggaaattttattgatgtaattacatcaccttccaccacaggttgcacgcctatgtagcgtccgttttctagcacataaatttggatatgttgttcttccgggcggactatccaatattcacttacgccttgttcttgatagagttcgtatttgtctttcatctctctttttgaattaccaggggagagaatttcaacgattagatctggcgcaccaatacagcctttttcgtccaatttattcgggtcacaaatgacacacaaatcgggttgcactaccgttttgattttgccattgctgtctggaaaacgaacatcaaagggagcaacatataattcacactgatgactatcaaaaacatctaagaatgcttttgttaatttcatcgaaatccgttgatgtaatcgattaggcgctggcgacattgccattattttgcctttgataatttcaacgcgctcttgaaatttccattttaaataatcgccatagctataactgccatttaaatctaattggctaaggcttgtgatttcattcatattaagctccgaattacttagctgtttatgtgagttttatctagcgcttcgctatctcattcccaactcaaaaatcattgattcaacttggtagctaaatttgaaacaagcggtaagttggaagccattttctgtagaaataatttcactggtaatctcacaaggctcagattctgttgatcgagctttgctggttaaaaatgctaaagcgtcttcagcttctgctttagtagtgtaaagttgagtaaaatttacagcacaatcactgttatcaataatagttcccacatcaatagaacagcaggaacttgaattacattcggacatattttacctctcgaaactggcaaactgtattcttataccactgattgtactacctttttccaacaacaacaacaacaacaacaacaacaacaacaacaatttttagtttaaaaaacatccattttaagatgtcatctttttatttgactggtcggaactctttgtattttagaggaattttattgcgaccgatgattaagctacgtagaatgacaatatgttttcatttcagttctttaatttattttttacgtgaaataaattaattttgatacagtcgattctataaaggattacctaatgaataaatttactaaaacagctcttgcttctatctttactttttctgcagctggtgcttctgcggcagcgttccaattagctgaagtgtcaacttctggtttgggtatggcgtatgcaggtaatgcggcagttgcagataacgcttctgttgtggcaacaaacccagcattaatgaccaaattcaaacaagtagaaatttctgcaggtggggtttatgttgatgccgatgttgatgttgaaggttcttttaaaggttcttttaatagaacagtaaatggaagagcgattccatcatcagcaacaggaaatgcaaatgcaaaagacattattccaagtgcaattgtccctaatttatatgttgttgccccaatctctgagcgttttgctgtgggtggcggtgttaatgttaattatggcttaaaatcagaatttgagaaaacctatagtgctggcgtattagcaggtaaaacaaaacttagtgcggtaaactataacttcagcagtgcttatgatcttggctacggatttagctttggtgctggcttaaatgcagtacatgcaaaagcaacattagagcgccattttggtgctttaaatcctatggcaccgacagcgacagcaagtcgattaaaaggcgataaatggggctttcgttggaatgtgggcttaacctatgatattaatgaaaacaaccgtcttggtgttgcataccattctccagtggatttacgtttcaaagggaaatatgtgggtactcaaagtgccaatgttgaaattccaggtcgcttaaaccttgagttaccagcatattgggaaatctcaggttatcataaacttactgagaaattggctgtacaatatagctataaaaagacacattggaatagcttccgagaacttcgtgcaacagataacaacggtagagtattgttacaaaaagataagaagttcaataataactctcgcattgcgttaggcgtgtcttatgatgtgattgaggcattaacattacgtgcaggtattgcttatgatgaaagtgcaagcgtggcacatccatctatctcaatccctgatacatatcgtacatggtacactttaggtgcaacttatcgctttaccccgaatttatctgttgacctctcttatgcacatttgagtggtagcaaaaatacctttactgagagccaagttacagcagttacaagtgcagtgggtgaatttaaagttaaatcaactgctaacctttacggcttaaacgtaaactacaaattctaattttcatttgatgtaacctcaaaggcgtgtacactaagtggcacgccttttgttttaggataatcctatgaaatttcagatattctatcaattttatgattcgccagtggggaaattgcttcttattgcaaaccaaacgggtttacttggcattgaatttgaacaagagcaacaaacacttaactttcaacaatggaaaagttcagaacaggcaagcggtgaaattcaacaactattttgcaaaacagtgcaagtattaaaccgctatttttcaggggaaaacgtggcgttttgtcagctagattttttaaaccctcagggtactgcttttcagcaagctgtttggaaaatattgcttgagattccttatggtaaaacggtaagctacggagatattgccaagcagttaaataatcctcacgccgttagggctgttggaggagctgttggacgcaacccgatttcgattttaataccttgccaccgagtgttaggcaaaacgcaagcgcttactggttttggtggtgggcttcctactaaacgttatctacttgaattagaaggtatttcttatcaaaataaaggcactgaatttgtaaacccaaaacataaaaaatggacatcaatatgacaaagcacaacttagcaactcaacttgttcacgcagggcgaaaaaaacgttacacccaaggttctgtaaatagtgttattcaacgagcctcttcccttgtatttgattctgttgcagacaaaaaagaagccaccaaaaaccgctataaaggggctttattttacggcagacgtggcacactaactcattttgctctacaagatgcaatgtgtgaactagaaaatggagctggttgctacctttacccttgcggtgcagcggcggtcagtaatgcgattttatcctttgtacaaccaggcgatcacgttctgatgactggagcagcctatgaaccaacgcaagatttttgtcgtatcgtattaaagaaaatgggggtttcaacctctttctatgatccattaatggcggaaggaattgcaacgctaattcagccgaataccaaagtgctttttctcgaatcgccaagttcactgacaatggaagttcctgatattccaacgattgttcgtactgcaagagcaatcaaccctgaaattgtgattatgattgacaatacttggtctgcaggcattctttttccagctcttgaacacggcattgatatttcaatccaagcaggaacaaaataccttgtggggcattctgacacaatgattggtactgccgtttcaaatgctcgttgttgggatcagctacgcgaacactcttatttaatggggcaaatggttgatgctgattctgcctatgtcaccgctcgtggcttacgcaccttaggtattcgcttaaaacaacacgaagaaagtagtcttattgtggctcaatggctggctcaacgctctgaagtcaaagcggtttatcaccctgcgctacctagctgtccaggaaacacatattttaaacgtgattttaaaggttcaagcggtctattttcctttgaactttgcaaaaccttatctgatgaagagcttgcgaattttctcgaccattttgaggttttctcaatggcatattcttggggtggatttgagtcgttaattttggctaatcaacctaaagagattgaacgtattcgcccagccattgaacgtaaattaacagggacactcattcgtgttcatattggtttggaagatgtggaagatttgattgctgatcttgaagctgggcttgagcgaattacatcgtaaatatcttcagaatatatttgttttcataccttcccccgcttacggaggaaggttcccaaaaggctgatagggatttcaatgacggaagtgacgcattccagttagtaccattgccattccgtgttcgttggcggcgtcgatcacttcttgatctcgcattgaaccacctgggtggataacgcaagtaatgccgacttttgccgctgcgtcaatgccgtcacggaatggaaagaaggcatcagatgccattacacagcctgccacttgtaagccttcgtcttccgctttgatccctgcgattttcgctgaataaactcggctcatttgtcctgctccgataccaatcgtttgtttgtttttggcatagacaatcgcattggatttaacgtatttcgctactttccagcagaagagtaaatcgtctaattcttcttgggttggtttgcgttcagacacaaattgtaaatcttcaacagcaacttgtccttggtcggcatcttggactagtaagccaccattgacacgtttgaagtctaaacgtggttgtgcttcgctaaattcgccacacgctaatacacgaacgtttttctttttcgctaaggtttctttggctgcttcagagatggttggggcgatgatcacttcgacaaactggcgatctgcgattgtttgtgccgtttcgccgtctaattcacggttaaaggcgataatgccaccaaaggcagaagttgggtcggtttggtaagctcggttgtaggcttctaaaatatctttgccaagagcgacaccgcaagggttggcgtgtttaacgatcacacaagctggctcgttaaattctttaacacattcaagggctgcgtcagtatcagcaatgttgttgtaagaaagggctttgccttgtagttgaactgcggttgccacagatgcttctttgagttcgttttcaacatagaatgcggcattttggtggctgttttcaccgtaacgcattgtctgtttacgggtgaaatttaagtttaatgtgcgtgggaactgtccgcagacttgggtaatatcttcttcctcagtaccttgatatggcggtactttttgtccgaagtagttggcaatcattgagtcgtattgagcggtgtgttcaaaggctttgattgcaaggttgaaacgggtttctaagctgagtgagttttggtgttgatccatttcagcaagaatagcgttaaagtcgttgttattgacgacaatcgcaacatctttatgatttttcgccgcagaacgcaccattgttggccctccgatgtcgatattttcgaccgcatcttcaagggtgcagttcggtttagcaacggtggcggcaaatgggtagagattaaccacgaccatatcaattcgttcaatgccgtgttgtgccataatttcatcgtctgtgcctcggcgacctaagatcccaccgtgtactttcgggtgtagggttttaacacgtccgtccatcatttctgggaagcctgtgtagtccgatacttcggttacaggtaaaccgttgtctgcgagtaattttgctgttccgccggttgagagtagttttacaccacgttgaactaagccttgagcaaattcgacaatgcctgttttgtcagacacacttaataatacttgttggattggacgatgagccattatgggttcctttgtatttgaataaaaataatgtagggacaccacgcttggtgccctttgaatatgtatataagattgaattaagtggacgccaggcgtggcgtccctacttgatcatagggataattataacgcaaccgtttgcgtaaatctatgatttacaaaacttaaactttaaattttgcgaaaatctttttttctcagtagaatgaacgaacgttcagtaacttgacttgtttttatgtttaagggtattttgcctcaaaatgaggtggcaatgtgtattctcaatgcaacagataggttgatggcaaaagaaggggttcaaaatctttcgacccacaaaattgcaaaagaagctggggtatctgtgggtacgatctatctttattttaaggataaagagactttgcttaatcagcttgtgttgtatttgtttaatacgtttcattctgcggtagatcgggaatatgatcctgatttgcctctgtttgagcaatataaaaaattgtggaatgcaacttggcagtttatgttggataaccctaatattgttaaaaatatgcatcagtacgagtcgctaccacaatttcaagcgacaatggtggaatgtttgaatgcagattgggtgacgtggaataaatttgtcaagcaggggcaatcgcaaaatattattgcgaacttaccgccttttgttttacttgcaattagtatgaaaacagcgtgggagttgatgtatcagcagttaatgttaaatcaaccttatgctcaagagatgcttgaagaagtgattatccgtacttggaaagcgattacgatttaatcaaaattgatatggagaaaatatgataataaatatgaaaaagacaacgaagggtaagcagtttgctattgttgtgaccttattggttgtgcttatcgtgtttggtggtgttgttggtatgcaacagtttatttcgatgaaaaaggctgaagctgcggcgaatatgcctgagcctgtgagcaatgtaacagtgatgaccgttaaaaatagagaatggacacctgttatttctgcggttggttctattcgtccgaatcaaggggctatgttaagttcacaggcggctggcacggtcactaaagttttggtgaagtctggcgataaagtgaaaaaaggtcagctattagttgaaattgatagcagtgcggaacaagccagtttgaaagcgacagaagctcagttatcgacagcgagagcaaactataatcgctatcgtaacttagtagcgtcaagcagtgcttcaaaagcggaatttgataatgccaaagcaacttatgagcaacttgtggcgactattgaggcgacaaaagctcagattgagcgtcgtcaaatttatgcgcctttcgacggtgaagcgggtattgtgaatgtgaatgtagggcaatatgtgacgattggcacaggaattgtgcgtgtggaagatcagtctgcgatgaaaattcgttttaccttacctcagactaacttagaagatatttttgttgggcaaaaagtgaccgcaaccattgatgctctacctgctcgtactttccctgcgaaaattaccgctatcgatcctgcggtggatacatcaactggtttgattaatcttgaagcagtggtcacagaagggcaagataagttgctttcaggtatgtttgctcgcttaaatgttgcattaccaaccttatacgatcaggttgttgtgccacaaattgcggttacttatacaatgtatggcgaaactgtttatgtgcttcaaccattatctgatgaagataaggaaaaagtgactaaaatggctgaaatgaacaaaagtttagacatcaataaaatctatcgtgctaaacagatggaagttacgacggctgaacgcagtggagtctattctcatttgagcaaaggcttaaaagccggtgatgtgattgtcactggtggcttacaacgtttaaaaaataacgccttaattcaaatttctgatgtacaacctgttggggttattgcaccagcgacaaaaacaaaactgtaatggggtaagctgtgaaatttaccgacatttttatcaaacgccccgtacttgctatctgtattagcctattgattacaatcttaggcttacagtctattagcaagctacaagtgcgtgaatatcctgagatgacgatctcaattgttactgtgagtgttaattatgcgggtgcagatgcaagtttaatgcaagcacttgttacgtcacaaattgaagaagctgttgcacaggcagataacatcgactatatgacttcatcaagttcaccaagtactacgacggtaacggcaaagatgaagttaaataccaatcctcaagaggcgttatcggatatttcttctaaagtaaatgcaattcgtggaagcttgcctagtggcattgatgatcctgcgatcagcgtatcatcgggatcaaatgatgcgtttatgtatattcgttttacctctgatgatctttcatctccacaagttacggactacctaaatcgcgtggtgaaaccgcaattttttacgatcaatggggtgtctagcgttggtatctttggtggttcaacctttggcttacgcatttggttagatccagatagaatggctggctataacctttcaggtgcgaatgtgttatcggcattaagtgcaaataacctttcgacggcggcaggcagtgcaaatggttattacactgtctataaaaacaaggtgttatcgacaactccaacggtagaagagctggcaaacattactgtggcaaccaaagcagatggtatgcaaattaagttaaaagatattgcgaccgttgaactgaataaatcttcagataatgctcgagccacagcaaatggcaaagatgcagtggtgattgctgttgagtctgcagcaacggcaaacaaattaaccgttgccaaaaatatctatccgttatttgcacaaattgagaagaatctgcccgcttccattaaagctgagattttgtatgacagcactattgcgattaatagctctatttctgaggtaattaaaaccattggtgaagcaacaatcattgtgcttattgtgattatcctattcttaggttcactccgtgcgatgattatccctgttatcactatcccgatttcattgattggggtgttattcttattacagatgcttgggttctcgatcaacttgctcaccttgctaggattgattttggcaattggtttggtggtagatgatgcgattgtggtattggaaaatgtagagcgtcacgttaaagagggtaaaccgcctttcgatgcggcaattattgggacgcgtgagattgcattgcctgtcatttcaatgaccattactcttgcggcggtatattcaccgatggcattaatggaaggggttacaggatctctgtttaaagagtttgctttaacccttgctggtgctgtatttatttcggggattgcagcattaaccctttcgccgatgatgtctagccgtgtgttaaaagaacataaagggggtgaagaagggcgtttagtcaaatgcattcacgctatgttagataagatgacaagctgttatcaaaatatgctttcagcagtgatggcagtgcgtggctttatgctgttctttgcgattgctatttttgcgagcttaccattcttgtttacttcattgtctagtgaggttgcaccttctgaagatcgtggtgttgtggttgcttttggatctggtcccgcaaatactaacttggattatacgcaggaagtgataaaaccttttaatgagaaagtggttaaattgcctgaggttcacggcgcaatgtcgattgcaggctttaacggtggcaacagttcattgtcgattatctctttaaaagattggtctgaacgtagcaaatcgcagtttgaagtgaaagacattgttgcaggtatggcaaaacaagtggttggtatggatattaacgccgttgctttccctgaaattcagacaggtgaaagtggactgccgttctcactggttattacgactgcagatagctatgaaaaacttgcagaagtcgccagtgaaattttagccaaagcacaagcgtcagggcaatttttcttcgctaacttagaccttaaatttaacacggcaacgatgaagatgaagtttgaccgtgagaaaatggggacttatggcgtaacgatgcaacaggtgagtggcactttaggttcgttcttgtcgggggctatagttactcgtgttgatattgattccagagcttatccgattgtatcgcaagcggtgagaaatgaccgattaaatccagaagatttaatgaactactatgtgacaacagcgagcggacaatctatcccattgggttcttttgtcacaatggaattaagtacagaaccagcttccctcagccgaatgaaccagcttaactcggcaacaattggcggtgtggtgtcgggttctattggtgatgccgtaaaatgggctgaagctgagttagctcgttctttgccatcaggctatcaatacgattttaaagccgaatctcgtcaatatatccaagagggtaacgcattaatgtttacctttgtgctggcagttgtgatgatttatatcgtcttagctattcagtttgaatcgtggcgtgatccgttggtgattttagtttctgttccgttagcaattagtggtgcattattggtgatgaatattttgggcattatgaaagtatcaggtgcaaccttgaatatttattctcaagtaggcttaatcaccctcgtaggcttaataacgaaacacggtatcttgatgtgtgaagtggcaaaagaagagcagttgcttcacggaaaatctcgccgtgatgctattttccacgctgcaactatccgcttacgtccgattatgatgacgactgccgcgatgatcgcaggtcttattcctctgctttatgcttcaggggctggtgcgattgctcgctttagtattggtatggtgattgtcgcaggtttagctatcggtacactctttacactgtttgtattgcctgtgatatatacctatttaggtagtgagcatacgccgttgagagagtttgatgaagcgaaatatgctaaggattaaactttaattcctgatgtagcggtaaaattaataagcaactcggtaagggttgcttatttttttgatagtgcagtagccaagacatagcgacatagtaaaaaggttaaagcctgatgaagctttaaccttttttaataaaagatgtaatttattggtgtaatagacaaatttgttgctaaaaagtggtttaaagccttatagtacaaggctttaagccctctttttgaaacatgaacaaaaaaactgcccattttgccaaagtcagaaaataaagaaacatggtatacaaaataatactcaacattatttttgtaatgaatgttataaaacgtttatcttaaaatctaaattagattcaattaaaatttggactgattacacatccggaaaacaaacctatcaacaacttgccgaaaaatatcattgttcggttagaactattcaaagatatattgataaagcccctaaaacagctttaaaactaccttcaaatcgatacctaaacatcattatggatacaacgtttttctgtcgttattttggcgtattagtgctaatggattctaattcaaataatgtgatttcccattactttgtgcgaaccgaaaaagatatttactacaaacttgctctaaataggttaagagaaaaaggctatataattcaatcgattacctgtgatggtaggcgtggtttgatgaaagatttatttaatacgccggtacagatgcgtcaatttcatatggtagcgattgtgatgcgtaaattaagaaaaaaacatcaatcgcaagcgggtaaagaattaaaaataattgcaaaaacacttacaagaagctcaaaaacgaattttatcggcgattacattcttggtttataaaacatcaaggttttttaaaagaaaggagtgataaagcgaatgaaaaaggctattttccttataaacatagcaatgtaagaaatgcttatgccagtttaaagcattatatttttacctatgaaaaacattctgaattaaatatagaaaagacgacaaatcgtttagaggggttatttagtgaacttaagcgaaaattaaataatcacaatggattaactaaaaaacgtaagatgttgtttatacaggattttttaaataaaaagagttgctaatatttcaagaaaatagatattagcaacaattttgtccacttggcatagtttttgacgaatcagcaactattttgtctactatgccaatttatcgtgactttggatactgtttttataagaactaatgtaccttcttaaccataaataaaatggtataaccttagccaatatattgttcgatcaaatttcccatctccgaggtagttacgggcatcgtagtatgatcagcaagatctgccgtgcggtaaccctcggctaatactttttgaaccgcattttcaatcgctttcgcagattcttccaaaccaaaactatgacgtaacatcatcgctgcagaaagaatttgtgcgattgggttagcaatatttttacctgcaatatctggcgctgaaccacctgctggttcgtataaaccaaatcctttttcatttaaactcgcagaaggtagcattcccatagagccagtaatcatcgcacactcgtcagaaataatatcgccaaagatattagagcaaagcaacacatcaaagaaatcaggttgcttgattaactgcattgttgcattgtcaatataaatatgatccagcttcacttcaggatattgttttgctacttcatttacggtttcacgccaaaggattgaactcattaacacattggctttatcgacggaagtaacgtgtttggtgcgtttcattgccgtttcaaatgccacttttgcaatacgttcaatttcataacggtgataaacttccgtatcaaaagctttctcattttctccctcaccttcacgacctttaggctgcccaaaatagataccacccgttaattcacggactgttaccatatcaaagccttttgctgcaatgtccgcacgcaatgggcaaaattgttctaagcctttataaagtgtagcagggcgaagattgcagaataatgcaaagtgtttacgaagtggtaacaaagcaccacgctctggttgctcatttggtggaagatgttcccattttggaccgcctacagagccaaacaaaatagcgtcggcttcttcacacccttttaatgtgctttctggtaatgcttttccgtgattatcaatggcaacgccaccaatatcataatagttataatttaatttaaacccgtacttttgttgaacagtatcaagcactttaatcgcttgagccataatctcaggaccaatcccgtcaccacttaacacggcaatgttgtagttttgcatataaatacctcaatatttgaaaatttataaaatataagttatattaataaaaataaataaaagaacaacatttttttataaaaaaatcaatttttattattttttagaatttaaatctaaaaattaaagaaaacattgtttttaatagctagacaagcggtcagattttttgcaaaatgcccaacattgtttttatgatgtaaaccttatgttaattttgttggaggattcaatgaaaaaactctcaggagcggaaatgattgtgcaatccttgcgtgacgaaggcgtggaatacgtttttggttacccaggtggctcagttcttgatatttatgatgcaattcacaccttaggtggaatcaaacacgttctggttcgccacgaacaagcggctgtacatatggctgatggctatgcacgttctacaggtaaagtcggttgtgtattagtcacatctggccctggagcaacaaatgcgatcacagggattgcaactgcctacacagattccattcctctggttgttttttcaggacaagtgccttcaagccttatcggaaccgatgctttccaagaatgtgatatggttggtatttctcgccctgtggttaaacatagtttcctcgtcaccaatccagaagaaattcctgagatcataaaaaaagcattttatatcgcttcaacaggtcgccctggccctgtcgttattgatgtgccaaaggatatggtaaatccagcaaataaattcagttaccactaccctgattctgtatcattacgttcttacaaccccacggtacaaggacacaaagggcaaattaagaaggcattaaaagcgatcttagtggctaaaaaacctgtactttttgtgggtggtggtgcagtgatttcggagtcaaataaagagttgatcgaatttgctcagaaattaaatctacctgtcacaagttctctaatgggattaggagcatatccaagtacagataagcaattcctaggtatgttaggtatgcacggtacctatgaagctaacaatgcaatgcacgaaagtgatttaattttgggtatcggtgtgcgttttgatgatcgtactaccaataatctcgcaaaatactgcccaaatgctaaagtgatccacattgatattgatcctacctctatttctaaaaccgtccctgcatatattcccattgtcggcgatgcaaaatttgtattagaagaatttttagcattgttaggtgaagaaaatctggcaaaaggtcaatcagatctgaccgcttggtggcaacaaattaatgagtggaaagctcgtcaatgtttacgttttgagcaaagtgatgtgattaaacctcaacaggttattcaaaccatttataaattaacaaatggcgatgcctatattgcttctgatgtaggacaacatcaaatgtttgctgcgttacattatcctttcgataaaccgcgtcgttggattaactctggtggtttaggcacaatgggctttggcttacctgcggctatgggagtgaaatttgcacaccctgaagcaacggttgtttgtgtcacaggtgacggtagtattcaaatgaatattcaagaactttctacggcaaaacaatatgatacccctgtggtgattgtgagtttaaacaaccgcttcttaggtatggtgaaacagtggcaggatattatttatgcaggtcgccattcccaatcttatatgaattcactacctgactttgtcaaactggcagaggcttatggacacgtcggtattcaaattaacaccactgatgaattagaggaaaaattagcacaagcctttgcaattaaagataaacttgttttcgttgatgtgttagtagatgaaacagaacacgtttacccaatgcaaattcgtggtgaatcaatgaaagatatgatgttaagtaaaacggagagaacagatgcgtagaatattatccgtcctattagaaaatgaatcgggggctttatcccgtgtcgttgggcttttctctcaacgtggttttaatattgaaagtcttacggttgccccaacggatgatccgagtttatctcgaatgaccattgtggcacaaggcgatgaacaagtcttagagcagatcgaaaagcaactgcataagctgattgatatattcaaagtgacaaatcttagccattgcgaacatattgaacgagaagtgcttctgctaaaagttcgggctgtgggtaatacacgagatgaaattaagcgaatggcagacattttccgtggacaaatcgtagatattacgccaaaacaatacaccattcagctttctggtacgagcgataaactcaatgcttttattgaaacagtgaaagcagaaacaacggttattgaaatcgttcgttctggggtgattagtttggctcgaggggaaaaaaacagtttataaaattgattaaataaatagcatagtagatacaacatcaatcgatgtgagtacacacacttttagttaaaatcattcctactatgcacttcacctaatataaatcaattaactaaacaatgcccaaatcggcttacagcttgaaggtaatatcaaatccttccctaactcaacccaacctgctgggtagtggaaatctgagccgacagaggcatagagatcaaactcttttgcccaacgagcaagaagctgacgctggtctggagtttgggcagctcccgttacctctatgccatctccgccagcctgtttaaactcttcaataaaacggcggatccatttcgttgttaatttatagcgtaatgggtgtgcaaaacagataacgccaccagcttggtgcgtcgctgcgatggcttcttcggtgctgcaccatacgggctttacataagctgttttgccgatccctagatagcgtttgaaggcgtgttcatcattgcgtgcatagccttctgccacaagaaaacgggcgtagtgagcacgagtaacttcaccgcttgcaatggcttttgccccttgatatgcgttcgggacacctgctttggcaagtttttcaccaatcaattctgcacgttcttggcgtaattgtttttggcgagcaagtaaattgacgatagcagggtgggtttcgtcgatatttaaggcagtgaggtgaaggcttttcccttcccataacacagaaatttctacgccactgataaaggtaagcggttggttttgggcaaaagttttcgcttcagcgatacctgcgacggtatcgtgatcggttaaggctaacatggttacaccttgttccaccgctcgtttaacgagttctgtgggggtaagcacgccgtcggacgcagtgctgtggctatgtaaatcatatttcatttaattatccttaattagtccaaccatagcgaaaaaggctcgataagcctctattttcttcgccaaactgagaggataagcccttgatgttgagggcaagcgataaagaaaaagttctctgttcgtttgataaggaaaagagataaattgattgctttttggtgtttttattttttctggtagtaacgatagcaacgtttctgttgccttttcccctgtggtaaaaatccaacgacaatgcagaagctgtgaaagaacttcatctaattttactggttctacaatggtcagaaatttatccgaagcgttgccttgctcacgaattgccgtttcagccgttgaacatagtgcaatgcctttttctcgtaagaatgcttcaatcctaagtgggtcaaaacgctttttattccctactcgaaagtgatcgacatcattaaaaaagatagcaccaaaaattcgccacatatcattttgaaaattagggtaatgaaattccatacaccgtttttctggtgtgggtggaaatgttcccatcatcattacgctggcgtttggtggcaaaatagcaggaaatgggtgtttttctattagacgcataaaatagaaaggcgtattaaatacgccttaaccgttattgttgtttttcacaagatttcacagaaacagaccattctgcccctgatttaattttgtattttcccgcaaaattatccatatttaaggcaaaagaaacattcaataaactattgaggtacatcaatggtctgccttcttcaacatcaccaaaactgctcttatatggcattgagccactataacggactttgacctcatctgccgttgtttctttgatttcaacacagaccttaccatctttttgaatacctgattgctcaagtaattcgtggctgatatttgtccagacatttccatattgaatatctagtacaggaatgttgccttttaatgtaccttcttcaatagcaggtttttggtagctaatttcggtgactttggcaggtaactctgcaccgacttcttcaaaacggatctgcccagacgctaattttgctcctgtataagcatagacatcgcgtccgtggaaagtataagatttttcagaaccttccaagcggtgttttgtttcatcaatttcacgaatgctctcaatccctaaaaattcagccactaacgttaatgtgccattatcaggggttacaaaatagtgtcctgttttagtttttaatacgaccgatttacgatctgtgccaacgcctggatcgacaacgctaacaaaaacggtgccagcaggccaataggttgcggtttggtataaacgataagaggcttcccaaatattatatgcaggaatttcgtgagttaaatcaaacatttttaacttgcgatcaaccccaaaagccaccccttgcattgcagatactgcaccatcttttaaaccgaagtctgtttgtaatacgagggcatttgcagcttttgtttcctcagaagcgactgcttgttttccgtttgttgttgcaaaagaagttgcagaaaaagccacaagagcaagagcaattaatgttttattcatatcgttttccttatcgtcgtgtttgtaaaaattggagtgatagtaatcgtttgcctagccattgtctatagcgagaacaagtttattttttattaagcaaagccccaatcgcttttaatttatccgctttactcagcccttgatcagcaagttgatttaattccgatactaatagctctgaagctggtgaattgacggacttggtggctttaggctgcattaattgtgctgcgtaagcggtgagatctgtcaataattttatcttttcaggattatcgtgatattgagccgataacagatcaaccgcttgttcaaaggcctctgcttttgtttcaagttgttgatagcaatacttttgccagcgtacttgttctgcgcgtgttaaggtttctgagtaatgtcttgctcgataatggaaaagtagaggttcaattcttggatcgctaaatttcaagccgtgatgtgcaagctcttcaggttttagatttcgcaaaatcgccatattgtttttatctgcaggttcaaaaaagccatcgtataacgtggtttctatattatttgacgctggataattcctttcctcagaaaaaatatcaataaccttttctcgcacaaggcttttttgggattttagcagttttaaattttctaaacaggcttgacgatcgatgcctaaacgtgttgcattttcagacagtaacgttttagctggagctaaaattgggcatttattaatatgcacgagttttagtggaacagcataaagcccttgagcttctaattctacttttttggtataaagacgttcacgcaatatttcgcttggctcattcaataggtcgtttatattccccgatagatcacatacaatcactgcgtttcgattagtcggatgccaagccaatggcacaacccaagcggtgttgcctcgatagttgcctaacattccagaaacgtgaacaagcggtgtcatttcaccgacatcaatcatctcttctagggcttttttacctcgattttgcaggaaaaagtcgaataatttaggttgtttttgtttgattaactttgccattgcaatagtagcatacacatcagccattgcatcgtgagcgttgtcgtgagcaataccatttgctttggtcaaattttctaatttaaagctcggcataccttcatcatcatacgcccattctatcccttctggacgtaaagcataacaggcacgcacaacatcaagaagatcccaacgagaattgccgtttttccagctatattcataaggatcgaaaaaattgcggaaaaaggtataacgggtcatttcatcatcatagcgaatgttgttatatcccattacgcaggtgttaggttggctaaattcggcgtgaatacgagcggcaaattcaggttcaggtagcccttgttgattacaaagctgtggtgtaatccctgttaccatcacagcttctggtgaaggcaaataatcttctgtttgttggcagtagaacattacgggttcaccgataatgttgaaatcgctatcggtgcggatccctgcaaattgtgcaggacgatctgtagcaggatcgataccaaaactttcgtaatcgtaaataaaaaaggtggtttgaaccatttattcgcctcgttatctcattaatttattaagtatttcaataagatataatttttttaaaattttttagaattttattgaactaagtttcattggggtagtcttagaatacgcataatgtgctagttttatttttcatttccttaggtaagacctcccccgatactgttttttggtatcggtttttttttatggtttcaaattatatttttataaacgtaattgtgctttttggtaaacgtcgttgcgctccctttttcccagtgcaaccactttgattacaatacgttcatcaatcacttgatacaccaaacgatagcctgcattacgcaatttgattttataacaatctttcattccacgaagtttagcactttctacacgcggattttcagctctttctttaagtttttcgataaattgttttcttaaatctaagcttagtttacgaaactctttttctgctgatgggataaattcaatggtatagctcattttaataaatccgctaaatccactttgtagcttttttcgtgttggcgttcttccactaattttgctaattctgcatcatcagcaagctcaatgagatattcataaatatgcggtggtacacaataaaaagcgggttcatttcggtttaaaattgcaattgcctcaccgcctgccgcattgaatgtcgccattggatttgtctttagctctgtaatactcgcaacagtattggttaaaataatacttggcataataatccttccttttttggtatcatttatcgctctttttataggtcttgtcaaggcggttcataagtagagaacataaacaacagattactttgagtttctgtacttgttggttcttaagacctcaacccaacccctctctcaattaagccataaacccaagcgtaaagtgctaggataaataagattaacacagcaaaagtatagtagatcgacacatcgctaatacctaaaaagccatagcgaaaaccgctgatcatataaacaatcgggttaaattgggacacttgttgccaaaattcaggcaataagctaatggaataaaacacaccgccaagataggttaagggtgttagtacaaaggtagggataatgccaatgtcatcaaaggttttcgcaaataccgcattaatcaatccccctagagcaaaggcaatagtcgtcatcaacatcgtaaggataatgatgccccaagagtatatttgataagaaacaaagcacaatgtcaccgctgtcacaaggataccgaccattacgcctcgcattatactgcctgccacatatccccaaataatcgtatgggtagatagcggtgacacaagcaactcttcaatgttgcgaacaaatttgcttaggaaaaatgatgaagctgtgttggtgtaagaagcggtaattgctgacatcattattaacccaggggcaataaattgcatatagcttacaccgctcatctcaccgatacggtgtccgataagtttaccgaagattaaaaaatagagtgtcgttgtaataattggcggtactaatgtttgtcgccaaatgcgtaagacacgttttgtttcttttattgagagtgttgaaaatccgatcatatatttatctaattttattggctattttaattgcataaacaactcttccaagcggttggacttatttcgcatacttaacacttcaatatgttgtgaactaagctgttggaataagttgtttaacccttgttttcggtttacttctacttcgatagtggtttcatctacccatttaaacggataaccgtcaataacaagcggtcggttttcacttaaatctagcaaaaagatctccgtttcgagttttgccaataacgctttcattgaggtattctcgatgatttgcccttgctgaataattccgatattacggcacagagtttccgcttcttctaaatagtgcgtagtcagaataatggttgtcccttgctgattaagctctcgcaaaaaatcccacaaactacggcgaagttcaatatctacccctgctgttggttcatctaaaatcagcagtttagggttatgcattaatgcacgggcaatcatcactcggcgtttcataccgcctgataattcacgggtaaaatgatcacgtttttcccataagtctaattttttcaaccaaatttccgcttggattaaggcttgactacgcttaatgccataaaatcctgcttggttaattaaaacgtcgatcactttttcaaactgattgaaattaaactcttggggaactaatccaatctgttgttttaattgaattttttgtttatcaagatcgtagccaaacacttttattgtcccacttgttttattcactagtgagctaataattccaatcgtcgtggacttgccagcaccattatgcccaagcaatgcataaaagtctccctgttcaacacagagatctatgcctttaagagcttgaacacctgttggatattgtttgattaggttttttatttcgagtgcgtacatattttctactccgccactgcccgaatagttgcttcgtccatttgagcatcaaaggcttgttgtaaaagttttaacttttcgtccgcttgtagtgcttgtttagcctcttgcgtgagctgttcaaaaataactcgacgaatttctaatggggtttggaactcatcactttcgcctattcgcatttcactactaaagccttgttgtgagagggcattgtataaactttgggtcgcttcattgctgtttaaatgtgccattgtggggtttaaaaccaacaaaagatgattgttgttatggctttctaaatagctgtttaaagcgagctgacgagaaactccgcccagttttaaactgtttacaattcggctccatttatctcgttcacaaccaagctcaatcgtttttttaactagctcaggtgttcgctcttgcaaaatggctttcttaatttctgaaggcttcggggcttcctcttgattttctaactcaggattaagccaagtccaacggtagtcttcatcattttgtgaagcgatagttttttgaggtgttttttcgacttgttgccgttgatcttgagcggtcactaggttcattaaaccttgttgaacgctctttttattcaccgtttggggtggttgaatgggggttaaatcagacttttttttttcgtcttgttgctcttgtttcgcttttaattgctgacgagcctgcattgcttttaaggctggcgatatactttctgcactcacttcagttggggtagcgggttgttgggcgagattttttgcaaactgttgttcagtttcgaccgcttgtgttgtcactgtttgagctgaattttgctgttgagctaaacgttctcttaactggctaatactatttggcgattgcataggtgcaacgggcgttgttggtgtaggtgtagcaactgttgtcgtggttgccatatttttagggtggaaagccaaggctcttaaaatagtcatttccacgcctgaacgttgctcaggggcaaaaggcaactcttttttgcctgtaagcattacttgatagaaaaactgcacatcttctggagagatctgtttcgctaaaaaatgcagtggggtttcttcttgatgaggatgtttcaacaactgcaacatcgcaatttggtgcaaggtttctgccgtatcgcttaacagttgttgccaatcgacacctttttccgccacagactgaattactgccattgctttttcgccgtccgcatttgcaagggcttgcaccaattctaacggttgatgatcgtcaattaagccgagcatttggcttacaatcggcaaggtgatattcacattactgacagcaattgcctgatcggttaagctcaacgcatcacgaatactgccttgtgccgcttttgctagtttagcaagtgctgacaattcatagggaatttgctcttgggttaatataaattcaaggtgttgctgaatttgcgattgttccaacgcacgcaaatggaactgcatacaacgagaaagaatggtaatcggcagtttttgcggatccgtggtcgcaagtaagaatttgacatattcaggcggttcttcaagggtttttaataacgcattgaagctgtgacgagagagcatatgcacttcgtcaatcaaatagaccttaaaacgtccgacggttggtttgtattgcacattgtcgagcaattcacgggtatcttcgacttttgtgcgtgaagcagcgtcgatttcgatcagatcgataaatcgcccttcttcaatggctttacagttcgcacattgaccacagggatcagcactgatccccgtttcacagttcaagcctttcgcaaacagacgagcaattgacgttttccctacgccacgcgttcctgaaaaaagataagcgtgatgtaaccgtccttctcgcaaaccattttcgagagcggataaaacgtgttgttgcccgaccacttcgctaaaccgctgtggtcgccatttgcgtgctagaacttgataggacatttgacctctttagatgttgcgtagctcttgaaatcccccctcccccccctttttacaaaggggggattgcaaagggagaaatataagattagtgaccttcaaagctcactaaggtataagaattgacaccgattttctctaagcgttctttaccgtcaagatcaggcaaccaaatcacaaaggctgcattctcaactgtaccacctaaacggcgaataagctgtactgttgcttccaccgtaccgcctgttgcaagtaaatcatcaatgacaagcacattatccccagcttgaacagagtctgtatggatctctaaggtatcttcgccgtactcaagggcataagattgcgaaattaccgaacgaggtaattttttcggtttgcgcacaagtacaaaaggcacacctaaagctaatgccactggcgcaccaaagataaatccacgagattcagtccccacaattttggtgatccctttatctctaaactcagccacaattgcaccaacagaggcttggaatgcggcaggcacttctaataaagaagtaatatcacggaagataatgcctgcttttggatagtcaggaatagatttaatggaagatttgattaactcaagttgttggttcattttttgaccttttaaacaagaaaaacaacctgtggaatgtagcaaaatttgcaggaattacaaggaaaaaatgatagaagcggtcggttattgcaaaaaattttatattttgtagctgttccacaagaaaagaaatgtaggaacacaactcaccaagtattcctacaatatttaattagaaagctccctatatttatatattatttacctcttccaacttgaccatcgctccttgaacagtatgttgaatttcaacggagatcaatcctctgatcaactcttcaatagattgaacttttgatacaatcgtattgccttcttcatcaaaatacccctgctctttcaatgtagcgctaaaagtcgagaacaatgctttatcaaagaactctggagcattaataccgtgtagcacagacagacgttgtgcaattgaacggctttcttgctcaagatgatttcgactaatttcaggttgttcaatcaaaatactcaagctgatgtaataacgttgtaataactctcgcacaccagaagagtgtaactgcaacgaacggatacgctggcggttaatcacaaacatttcactttcgttcttaatcagattttgagcaacaaattccgctaaaattgcctcaatatgcccacgaacttcctctgttttaaagtgcataaagagttctgcttgtaagaacggataaatgcgattaacactctggataatcaaatctttggataccgtctcgtgatgtaacacaatacttgcgaccaatgatggaaaaacaaataaatgctgaatgttattgcgataataggtcattaatactgcagattgacgatctaaacggataatttcaccaaagttgtctttttctgagataacacctgaacgaggtaaattaataacatgatctaacatcgcttcagctgtatccgttggcaaagtgacctccgctgtataaggtacatttttgaacagttgcatatagctttcaacctgctcaataagctgttcacgcgttaaagaacgttggcgtgaagcaagcaacacagagccaatgagatttttcgcattgactgcgacgacattattaatatgcaccatcacttgtttagataccgcttcaacggcactatttaaccattttggacgaccgttttcatctgtaagcggttctttccattcaggaaaatactgattgagatagtgattaagtggaataggttcgccaaaattcacatagccttgccctagttttttcagtttcttaatcacacgtaacaccaagccagcattctctttctctttctctgcacctcgtaattctttagcgtaagtatctacttctaaaacgtgttcataaccaatataaacaggcacaatactgatcgggcgagttaagccacgttgcaatgcttgtaacgtcatcgacatcattcctgtttttggatcaagcaaacgccctgtgcgtgagcgaccgccctcaataaagtattctacggaataaccacggtagaacagctctgcaaggtattcacggaaaatcgtagaatacagacgattgcccttgaaagtacgacgaataaagaatgccccccaacttctaaaaataggacctgcaggccagaagtttaggttgatcccagcagcaatatgtggcggcactaagccttgatgatacagaatataagagagaagcagatagtccatatggctacggtggcacggcacatatactaactcgtgtccttctaatgccaatttacgcacacgctctgcatattgcacgttgatcccttgatagagtttattccacaaccaacttaacacacgatctgcgcttcttaagctgtcgtgacgaacatttgcagcgatttcatccagaattttctcagcttctttgcgagctttttcaagcgaactttttggttttttcgcttcatcttcaatcgcagccaaaattgcaggggattgcagtaatttattgaacatcgcttgacgatcaggcagttgaggacctgttgccgaataacgctgtttagcaaaatgcatttttgccacacgggccaatttttgagccagattttcatcggttccgtgattggtaatcatatagcgtaaagaaaccgcttgtgaaaaacggataaaattatcacgtccaaaccaaagcattgtcactaagcgttggaaagttcccagcagacgtaatactggcaaacctttctctttacccggtgcgcgtccccaaagcacagagacaggaacaacttgaatgtctaactgctcatcattacggtttaaatctaaataacgatagaaaaccaactctgtttcacttttcgcccctttggatttaaagaaacgacgcccttcatctaaaaagacaaaacgagacaaagataccccttgaatatcattatttaccagcggatcaggcaagttcagagcttggcagtttttttgcaaaattaacagatccgtttgtgaggtgtagggcaacacatacacaataggttgatctaacttcagccctaattcattcacaggatctgtaggaattgaacgtgttttcactaacagcgaaagcggtaggttcaacgctttacgatacaggtttaatagcatagacatttttatatccttttatagttatgatcggattaaaacgatgcgcagtttagcataaatttcttaaggaaatctgagtttattcataaaagttgaggaataaaaaaacatcgtacttcttcaaatacgatgttttataacatgaaatgacaaggcctcattcccatttctctcatactaacagattactctctcgttgatttttctacttttaatccatcaccttcgtaaccttgacaaaagccttttaaaaataggtttaacttatccgtattacgtttaaaggctcggcaataaggacaaagcatcaaatggatttttagttgaatatactggcttttacgaagagattgctcttgttgtaaagagattaattcactaatttgttgacaattaagcattttattctccaaaccatttttgtgataaacagacttgtagttgtagcctagctctatataacaaggtatgtaaattgctggtagaaatatcacactcttggcaaatcatctggctatctaactctaaatgatgtcgcatcataaatacacgagcttgtatcgcaggcaactgattaatgcaatactcaaaaattatccaaaactctttgcgataaagactttgttctactccctgccattcacttggttgaaaggcattatcgtcccatttcccttgcttaaaaatctgctctgcaagatgaatattatcgtactctaagtcgctttcagtcacccatttctgtcgctgtcttagattatctatgattttgtttttcaaaatagcaaaaatccaagttttgagagaggcttctcctagaaatttatcggcatattggtaggcactgcttaatgcctcttgaaccatgtcttcagcgagagattgatcattaagttgcaagcgggcaaattgcaacatttgcttgcgaatttttcctagttgctcagagggaatgcatgttaaatagtcagtttgcattttttactcggcttgttgcttaatttgagaaggaaaaatcacctgtgcgttaatccacttttgccaaatattctgaattaaaggtatggagatttgttctacggataacaattgagttagctcttccgttaattgatttaaacttaagggttgctcttgtaaacaggataataaataaaaatccaactcacttatttcttggtagtaaacatcaaatttacgatttcgccaaatgataagataacttggttgggaaattatttgctcaaactgatttttcaaaaaatttacatcataatgtttgaggtaagtaacaggtgaaagttgcattagtgtgtcggcatcccaagaaaaatgtgtagggatctccgcaaacgccacttcggcaagtagctgagaatattcaaaatccattaatgctaaaatatcagcacttactctctgttgttgctgacaaaaatgcaaaaattcaagtgcaatttcttggaaatatggtgaatgagcttgtcccgtttggataaaatcttcttgaagctgttgccattgctcaggatcacagtgctttggtgtttcagtaaaacaacgctgaataaatcctaaaatactgttacgaactaactgcgcataaatacgtaaacgatgaggctctacaccctgaagcaaagtgcaatcttttcttcttattgcattggcaaaagctcgttgtgtttgtgcaagagcagtctgtttatcggtcattttttcctctacttagcgtattgtcgttgtaaccgagcgatatgttccacctcagcataaagttccataaacggtggaaaattaaaatcacgttctaataatgttggcggaatatggggtaaacgttgataagtgtaagcaagcaaatcccatacagaacctttaaccttctctccgtgagtgtcaattaacaattgcggtaaatgacgaaattcaccttgaactttattaaaggcttcctcacctgtatttacttcgggtaacacctcttgttcttcattgtgtcctgcaatatggatataacttacccttttatgatccacttgatcaataaattgataagggtctaacaaaccatgattgaccccatttacataaatattgtttacatcaagatgaatgtcacaatctgcttcttgagcaatcgcatttagaaactcgacttcattcatggtgctagtgggtgaatgtaaataatatgaggtattttcaagtgcaatttttaaacctaaataatcttggacttcacgaatacgttgtgccgtatgcaatacagcttcatcagtaaaaggcataggtaataaatcatataaatgcccttcacattcgcaatagctcaaatgttctgaaaaaaatgttgatccatattgcttcatcaatattttaattgactttaataactccttatcaagaggtgcttgcccccctaaagaaagagataaaccatgtaccgcaacaggaaaacgttccgcaacctggtcaaattgatagcgagctgaaccacccatcttgacccaattttcaggagcaatttcaatgaattgaaccgcactttgtgtaggtaattgtaaaaaaccattggcaagatcacggcgatagcccaagcctgaacccactaacatcatcattccttataattcaattttattcaaaaatagtgaaatggtaggttaaccccaccattattttcccatcatttacttccgcatttaccttcgccacatttgccttctgctgtttttgtagctggcattttagtcgcttcagcaccgcacttaccttccccacatttgccttctgcagacttcggtgtagttgattttttggcatcagaaccgcatttcccttcaccacatttcccttcagtcgctttagttttgacacacttttcaccttgcatttccacacaagtttctgctgtcttatcagtttgagcttgagctgaaactgccattgataatgcacctgcaagtgccattaatgttgtttttttcattgagatcacctttataatgattaacaaaatttcaaccaagttagtttggctgaaaaccttttctgtagccaaaaatccacagaaaccatacctgcaccttgaaacatcaaaggcgctaaaattactaggtaaaccagtgccatcttgtaaccattttggcagacgttataccccataccagaatgtactgcataccaagctacgatagtgagtacagataaacctaaagcactaaagcgagtaaatagccctactactaataacagtgggaataacaattctgctcccatagcaaatgcccagtttatttcagaaggtagtaaataaaatggaaacggaaactgctcttgaatatcagcaaaccaattttgcccataccatttttctaaccctgcttcaaaaaattcataagcaacaaataaacgtaagcctagtaaaccaaatcctgccaatacatttttaatcataatgtcccttttgttttgtggttttattgattagacgaagataacagagatttctgacaaaatatttttagatatttagggaatatagtctttatatgtgaaaagtcagtttggagtatgggtaaaagtcagtttggagtatgggtaaaacttagtttactgtgtttgaatttcttacataaatctaaaattatttcgttgcaaatgaaattttactgtatataatgtcataaatttctgtatataaagacagtgaggaacttatgaaacgtcagcacctaacggctcgtcagcaagaaatctttgaatttgtaaaaaatcatattgaaagtacggggatgccgccaactcgtgtagaaattgcacgcgaaatagggtttaaatcgccaaatgccgcagaagaacatcttaaagctcttgctcgtaaaggctatattgaaatgctttcaggaacttcgcgtgggatccgtattttagtggaagatgaagccgcaaatgatgaagagggtttgcctttaattggtaaagttgcagcaggtacgccgattgaggcgattgaacatattgaaaaacattatcctgtgaatggagcaatgttttcaccagccgctgattaccttcttaaggtgaatggaaactcaatggagaaaattggcatcttagatggtgatttactcgcagtgcataaaaccaaatctgttcgtaatgggcaagtggttgtcgctcgtgttgatgatgaagtgaccgtcaaacgcttagagaaaaaaggtgacttaatctatttacacccagaaaatgatgaattagagccgattatcatcgatcctcgtcaatcttatattgaaatcgaaggcattgctgtcggcgttattcgtagcaacgcttggatgtaatccttcagatttcgattgaaaaaatgttcagaaaaatccaaaataacgcctttcaaattttggctttacgaagagattatttatgaatttagcagaatttcatcaagcgattgaacaagtgtgggaacatattgaagaacaacttgaagaacaaggttgcgatgtcgattgtgaaacacaaggggctgtttttactattacttttgatgatgattcacaaattgtcattaacaagcaagaagctatgcttgaactttggctggcaagtaaattaggtggttatcactttgcctatcgtgatggcgattgggtcagtgcggaagggcgttcattttggacacatttagaagaggcagtcgctcgtcacggcgaaaagatctcttttagctaatgtcagttataccgcttgccaaagctgaaacggttttacataacgttttcggctaccaatctttccgacaaggtcaatcagaagtgattgaagcgatcttgtcgggcaaagattgcttggtgattatgacgacagggggcggaaaatccctttgttatcaagtgccagccctctgttttgaaggcataactctcgtgatctcacctttaatttcgctaatgaaggatcaggtagatcaactgctcaccaatggtgttgaagcaggctatatcaattccacccaaacgattgaagaacagcaagcggttgaacaaaaagcgatttcgggacaactcaagctactttacctttcacccgaaaaggtaatgacatcaaatttttttcaatttatctcattgtgcaaaattagcctgattgcagtcgatgaagcacattgcgtatctcaatggggacacgattttcgccctgaatacaccttgttaggcggtttgcgaaaaactttcccaaacataccgcttgttgcactgactgcaactgccgatccgacaacccgttttgatattattcatcatcttaagttagaagatccccatacttatttaggaagttttgatcgtcctaacattcgctatacggtgcaagaaaaatttaaacctgtggatcaactgatcaaatttatcagcagtcagcaagggaaaagtgggattgtttattgtaatagccgtaaaaaagttgaagaactcacggaaaaactttcttctcgccgtttttctgtaatgggctatcacgcaggaatgacgatgcaacaacgggaaaccgttcaaaatgcgtttcaacgagataatattcaaattgtcgttgctactgttgcctttggaatggggatcaacaaatccaatgtgcgttttgttgtgcattttgatctgccaagaagcattgaagcctattatcaagaaacaggacgagcagggagagatgatcttcctgcggaagcggtgttattttacgatcctgcggattatggttggctacacaaggtattactagaaaaaccagaaagtgaacaacgtcaaattgagcaacataaattgcaagccattggggcttttgccgaatcacaaacttgccgtcgccttgtgttactcaactattttggtgaaacacgccaagttgcttgtcaaaattgtgacatttgccttgatccaccgaaaaagtatgatggcttagttgatgcccaaaaagtgatgtccgttatttaccgcacaggacaacgcttcggcttacatcatattattgcagttcttcggggcttaaatcagcaaaaaatccgtgaatatcaacacgacactctatctgtctatgggattggcaaggataaatcgcaagaatattggattagcgtaactcgccagctcattcatcttggctttattcgccaaaacattgttaatcattctgccctacaactcacagaacaagctcgccccattttacgcggtgaaacagccttggcactggcttccccacgtttaagtttttcggcgacgacttatgtgcagaaacagcaagctagcaagcggtatgataaagatctttttgctcgtttacgctttttacgcaaacagattgccgataaggaaaatatccctccttatgtggttttcaatgacgctaccctacaagaaatggcagaatttatgccaacgacggcagatgaaatgctttccattaatggggtaggtgagagaaaactggagaggtttggagaggcgtttttagggcttattagagagcatttatatcatatagaaagtattgtttgtgattaactttaggggctgtattagattggccctaaagttaaaatcaaactcttgcttcacatattacgatactatagtcgtaaaatatccaattaactcgtcctcactcaaaattttcactcccaattcctgtgcttttgccaattttgaaccagccttttcccctgcaatcaaataatccgttttacttgatacactgccagatactttacaaccgagttgctgtaacaaggcttttgcttgatcacgggtgagctgtgttaatgtccctgttagtaccactgttttatcttttaatggattgtcagcaatctcttgtggcaccacatcttgccacttcaccccttgagcaatcagatcttccacgacttcaacattatgtggttcttgccagaattggaatagacggtttgccacaacttcccctacatcttgtacctgttttagcgtgtctaaatccgcttggcgaatcgcatcaagcgtaccaaagtgatttgcgagattttgtgcggtagattcgcccacatctcgaatacccaaagcaaataagaagcgggcaagggtggtattttttgccttttcgatactttgtagtgcgttattggcagatttctcccccattcgctctaaacgcatcaaggtggtgtgatcgagtttaaacagatctgccggggtatggatcagctcacgttccatcagttgttcaatcagtttttcacccacgccgtcaatatccattgctttgcgtgaaacgaaatgctttaacgcctctttacgttgggctccgcagaataatcccccagtacaacgagcaacagcttcgccctcaacacgtactacagctgagttacacacaggacaagcggttggaaaagcaattttttttgcattgtcaggacgacgttcagccacaacgcccacaatttgcggaataacatcacctgctcggcgaataatcacggtatccccaattgcgatccctaaacgctcaatctcatcaccgttatgtaaggtggcattgctcactgttaccccagctacaaagacgggctctaattttgccactggggtaattgcccctgttctgccgacctgaaattcaacatcgttcagaatcgtcatctcttcttgtgcagggaatttgtaagcaattgcccaacgaggtgcttttgagataaagccaagctgttcttgcaatgtaatctcattgactttcaacaccgtgccgtcaatgtcgtaacccagcgaactacgtttggcttggattttttgataaaacgcagtcaaggcttgagaacccgttgctaaggtaatttcagcattgacaggaatccccaaggtttttaaccactgcaagcggtcaaaatgtgtcgttgggagttcatcatcactttcataaaccccaatgttataggcattcaacattaacgggcgttggctagtgattttcggatcgagctgacgaagtgaacctgccgctgcattacgaggattagcaaaggtcttctcaccttttgccagtgctttttcatttaactgctcaaatccttgctgtggcataaaaacttcaccacgcacttctaaacgatgcggaggattattggttttcagttttaacggaatattgcggatcgtgcggatattggcggtaatatcttcccctgttgtcccgtcgccacgggttgcagcttgagttagtactccatcaacataaagaatactcaccgctaagccatcaagtttaggctcacaacaaaattcaatttgattactgttgatcgcaatacgatcttcaatacgacgcaaaaagcctgtgaggtcatcatctgaaaaggcgttatccagagaaagcattggaatttcgtgggtaatttgagcaaaaccatctaacggcttagcaccaacccgttgtgtcggtgaatcggacctaatcaattcggggtgttgccattccagattttttaactcgttcatcaagcgatcatattctgcatcgggtacaagtggattatctaaaacgtggtagtggtattcatattcacgcaatttttcacgcaaatgttcaagttgggtttcaatagagtgtggcatctgtaaatttctcgataaaaaagaccgcttgcaagcggtcatatttaaacaatgtactgcaaattaattggctactcgtagtagataattttggcgagattcctcgttaaaaatttgatgttgttcatctaagacaaaaccgccaacagattgagcaaagctctctacggtacgaatcattaattttaaattagctagatcattacctactgaaggtaagtgcataaagaatactaatcccactgtagaaaactgttccattcttgctaaatcaaagactcctggttgcatcatattcgccacgctgaacaatacaggacttgcaggattatctaaatggcggtggaagatctggtattcaccaaaatgaaaacctaacatttctaaattttgtacaatggcattaccttgaaattgaacgccttctggtgcaacaacatacaaagtgattatattatgctccgtagtttgttctattgtttcaacttgctctacttggacagtctgttcttgtatctgattttgttgatatgcttcagattgagattctggcatagactcttgatataaaggttgagatatttcttgagtttgtaaactaatacgaatatttttgacactattctcaacttcttgctgagattgaataaaatcagcaggtgtttcagtattgaatggttgctgagctacgacaccttgaggatttagcgttgttggaatatctgctgtaatttcattgttaattggagatgaaggcggacgagtggaaaaggtatttgaaaaaatacgagatttttctctgcgtgcagaccaaatactgtatccaattaaaacagcgattaataatcctgctaaaataaagaaaagaatatgagtttccattttgccctctttagctcataaaatcatcaaaattgaaatttaacactttgtgaaaatgtgtgcatagcttaccatatttcttctaaaaatttgaatagaaaggttaattatgtcttcgctattttctaccccagaaacacaaattggtgctggctttcactatttcatctatggttggcgattaatgttacagcgtcagttaatgccatttattatttttcctgtaattatcaatgcagtgttgatgattagcctaatttggctcttttttgccaatgtagggggaatgttagattcgctcttgccttcgtggttagaatggttgagttttatccttattccattggcttttttaatgattttagttgctttctactttgctttcaccactttagcgaattttattgctgccccatttaatgcgttactcgcagaaaaagttgagcaacaactcacggggaaaaatctcatggaaatgagttttaatgaaatgctaaaagatatacctcgtatgctcaaacgtgagtggcaaaaaatgtggtatagcattccacgtttggttgccttatttttattaggttttatacctgttttagggcagactattatccctatcttggcatttattttcggggcttggttaattgcaattcaatattgcgattacccttttgataaccataaaattcaatttcaacgtatgcgaaatgcattagcacaatatcgtacaatgaattttacttttggggctttggtaagtatttttacgatgttgccatttattaacttagtggtaatgcctgttgccgtgtgtggtgctacagcaatgtgggttaatgagtacaaaagagctctgcatgattaacggaaagctgacattaacagaggaactaatcttataaagcagtgcgtatgttttcttctcccaaaagactagttaagggagaggaaactttaagcatagactcggcacttagctattctaattctggctgctttcttccgaacctgaccaagtaaattaaagactactgcgagaagcccaaagtttcctcatagaaagacatctacatttatactgtagatgtcctaattatatgagcttatctcaaagaagacaagaaaaatgtctactataaatagctatttcttacagggaatagctgttcaacaagactttaacttataaattaatcaccgcaaaaatcactaatacactataaagtgcagataaaccatagaaaatccaaccgcctgcaggaacgtgaattttaaagtcgtgtaaacctaagtgaacacggtgcataccacaccacattgggaaaatcagtaatgcaagaattgctaatttaccgatccaagtgtgtgcaaatgcaataatattatctggtgtaatcagtccgaatggcagtaagaaacctaagattaatacaagcacagggaagaagattgcactaatagcaccgccagcaccgaaaagtagccatactgcaggttcatttgaacgtggaggattaagtttatccatttttatgctctccctataccaagattaaagctaaaaggcttacgaaagcagtaataccccaaaatacgcgagaaacgagtttaacgtcaatacgttcatttttcacgataacgttcatcatttgaggtgccataccaaagaaggtaaagctatttaataatactgcaccaagggtaataatatttaaaactaccactaatggattttgtaagaatggaatgaaattctctacaaatccgttctcttttcctaagcatgctaagccgtagaaaagcactaaacagaaccaaatggtaggaacagaggtactttcacgcaaaacgtagaatttgtaaaaatctaacgctttccaccaagttggtttcacttcacgcacatattttttgcgtttacttgctgttgttgtcattttactctctccttacttttgcggttttaacattgcaaagacataatctttagcactttcgatcttaccttggtttaccgcagaggctggaccaacatgcttcggacaaacttcagagcaatagccgacgaatgtacagctccatacaccgtttttgccgttgataattttcatacgttccgctctaccattatcacggttatctaggttgtaacggtgagctaaggttaatgctgctgggccaacaaattcagggtttaagccaaattgtgggcaagcggcatagcataaaccgcagttaatacacattgagaaggtacggtatttctcaagttgtgctggggtttgtttggtacggcttttcgcaagctctgctgatgggtgtggtttgccatcaagttcaggcgctttgttgtcaataatgtatggcttgatgctttctaaactttcgatgaagtggcttaaatcaacaactaagtcacgttcaatcgggaagtttgcaagcggttcaattcgcatataacccctgtaatcgcgtaagaatgttttacatgcaagctttggtttgccgtttaccatcataccgcaagagccacagatcgccatacggcaagaccaacggtacgaaagctctggctctaattcatctttgatgtagccaagtgcatcaagtaacgaagtttggctatcgtaaggtacttcatattttgataagtacggttcgttatcttgttcagggttataacgaagtacttctaccgtcattttactttggttagtcatcttctgttactcctttttcgctgctttttcttgagcttctgcttctgcaccataaacacgtttagccggttgtgatgtggtaattttcacgtcgctgtatttgattgttggtgcgccgtctgcattgtagaatgcaagggtgtgttttaagtagttcacatcatcacgttcaacgtagtctaaacgttggtgtgcaccacgagactctttacgttctaccgcagaagatgagatagattgtgctacgtcaaggatataaccaagttcaattttgtagagcaagtctgtattaaatacacttgagctgtctttcactttgatacgtttgtaacgctcttttaactctgcaattttcgctacggttttttccatactttcttgagtacggtagataccacagccttcttccattgagtcgcccatttcgttacggatttgtgaccaagactcttcaccctcttgacgggctaaggcataaacacgttctaagacatcttttgcttgagcgtcaattacggcttgattacgagcggtcgcttcaacagcacgttttgcagccatttcacctgcaactttaccgaataccacaagttctgctaatgagttagaacctaagcggtttgcaccgtgtaaaccagaagatgcacattcgcccactgcaaataagcctttgatacaggtttctgcgtgctgatcaacttcaataccacccattgtatagtgaacaactggacgaactggaattggtgctttcgctggatctacgccttcgtaggcttgtgctaattcacagataaatggcagacgttcgtgtaaatatttttcacctaagtgacgtaggtcaaggtgaaccacatcaacacctttggcagtttttaaggtgttacctttacgccactcttgccagaatgcttgggaaactttatcacgagggcctaattccatatatttattttctggtttgccaactggagtttctgggcctagaccataatcttgtaagtaacggtagccatctttattgactaagataccgccttcaccacgacaaccttcggtcattaagatacctgtgtttggtaagcctgttgggtgatattgtacaaattccatatcacgaagtggcacgccgtggcgatacgccattgataaaccgtcacccgttacgataccgccgttggtgttgaaacgataagcacggcaaccaccacctgttgcgataactaccgcatttgcattgatctgaacgaaagttccttccatcatattcattgcaacacagccacgagcttgaccttcatcaacgagaatatccacgacaaaatgctcatcaaaacggataatttgcggatatttgattgaggtttggaatagggtatgcaataagtggaaacctgttttatcggctgcgaaccaagtacgttcaattttcataccaccgaaacgacgaacgttcacatcaccatcagctttacggctccacggacagccccaacgctctaattgcgtcatttcaactggcgagtgttctacgaaatattcaacaacatcttgttcacaaagccagtcgccacctgccacagtatcgtggaagtgtttatcgtaagagtcttcctctttagcgactgccgccgccccaccttctgcagcaaccgtatggctacgcataggataaacttttgaaattaatgcaattttcaaattcgggttagcttctgctgctgcgattgcggctcttaaaccaccgccacctgcacccacaattgcaacatctacattgacagtttgcacgatttcctccttgggaaagtaaagtatataaacctaacatggaagcattttgccattaatttggatattttataatgaatttttacaattttgtaacacaaaaaaaatagttttgtgatctatctcaaaaaataattttcagaatgctatgtagtgataattaatctcattaagtaggtgatttttaaggatatttgagcatttaatacggaaatatctttcactttattctcagattttcgtttgatttttagcatttcatctacataatgatgttgtataattgatagcgttctaaaatggaagaggatataccaatgcaatataagtagacaaaagtgttggttttaattatttcccctaattatcaccaactctttttattcaaaaaatcctttataaacataatcttatgctttttcgttaatccgctatgaaccgataatttctgtttcagttctttaaataacccttccaacctatttgttgttttttctatatttaggtgagcatattcttcaaaagtgagcttaaagccttgtactataaggctttagcccacttttttaccaacacttttctactatgccaaatatcctatctaaatcaccgctttcattagatttccgcctattatttctaacttttattgataaaagttgaaaaattcttgttattttattcttagttttgtgtaaatcattgtgtttttttttttttttttataatggggtgggggaaagatatttttgagatttcccctttcgcttgggcgatgaaggtatttgtgcatcctgaaaatgtaaataaaggtttatgatgctttattaggaaaagcggtagagaagattattatgaataaaatatttagagttatttggagtcatgctcaacaggcttgggtggttgtatctgagttagtaaagtcttataccaaaacatccgcttacacggataaaagagctcaagtatgcacctcacattattttttagataaacagcaagataaatttaaattaagtcttttaagtctagtattactaggtatattttttagttcagtaggttcagcttcatattttgtagatggtggagatgggagtagtaggggatataacaacgattctattgctattggttacagtagtcttgctgggtatggtggtgttgctattggtggtttagcaaaagctgaaggtaggcataatattgcgataggttatgacgctcaagcagtctatgaagaaaattccacagccgttggggcaagatcacgagtaggcaatcattctgcggcttatggttatcaagcaagtgcactaggagtaggctctgttgcagtcggtgaaaatgctattgcaaatatgaatattaatagaggcactgcattgggtaacaattcatctgttagcgttggcggtggtgttgcattgggttattactctaaagcagacacggcagggggtattgaaggagcaaaacaaactttttctgtgacagaaggagaaaacactgttgagaatggatttaaatctacacgacaaaatttaggtaataatgttggtgcggtttctgttggtgaccatactggtcgtaagggaggtagtagcataatcaaacgtcaaatcgtcaatgtggccgcaggtacacaattaactgatgcagtaaacgtggcacaacttaaatctttgacgatgaaaattgcaggcgatacaggcaattctaataatgagaaagtgggtatttgggatggtacgcttaaagtgctaggcacaaatggcgaaatcaagaccaaagcgtctggctcaaccattacagtatccctagatgatgcaatcaaaactcaactccataatgctcgagcaggaagtttgatattcaaaggcgaaaaaacaggtacaggtacaacaaatgatacttcgggtcaaaaatggaaggctaacgaagataagaccgttaccattacaagtaacgcaacataccaaaacggtggtggtgttcgatacaaaggcgataacattgaaatttatcgtaaaaatctagaattccatgtgttgatgaaagatgcaccaacattcagcagcgttcaatatggcgataatggacctaagattaccagcactggcggtaatctaaaagtaacaggtgcagacagcacttccccagttaagatcaccaatttacaagcaggtacacaaaataacgatgcggtgaactacatgcaattttcaaatgctggttggaaacttgcaattgctccaggaacggggggtcaagcaactccacctggggcacgtcttatcagaatgaacgataccgtaacctttaccgctggaaataatattaaattagaacaaaataacggaaatattacgatttctacgattggtaagttaattaaagagactaaaaccttagataatggcgatctaaaaattacctatacagataatacggatagcatcatcaaaaaaggtgaaaaaggagatacaggtcctagaggtgaaacaggccctgcgggtccagtgggtccagcaggtgctcaaggtccagcaggaccagaaggaccgcagggaacagcgggtgctaggggacctaagggtgaccgaggagaaacaggcccagcgggtccagcagggcctaggggtgagcgaggcgaaccaggacaaacgggtccagcaggaccacgaggccctgtgggtccaatggggcctgctggtccaaaaggaaatgatggagctccaggtgctaggggagagaaaggtgaaactggcccagcgggtccagcaggtcctgcgggtccagtaggtcctagaggcgaaacaggtcctaggggtgagaaaggtgatacgggtcaaacggggccagcaggggctgctggtccagcaggaccacaaggtgcaacaggaccacaaggcccagcgggagagccaggcaagcaggggcctaggggggataaaggcgaaactggccctgcgggtccagcaggggctaagggtgaccgaggagaaacaggcccagcgggtccagcaggaccacgaggaccgcagggtgaccgaggagaaactggccctgagggtcctaaaggagatgcaggtcctagaggtgaaacaggccctgcgggtccagtgggtccagcaggtgctcaaggtccagcaggtccagcaggtgcaactggccctgcaggtccagcaggggctaggggtgagcgaggcgaaccaggacaaacgggtccagcaggaccacgaggccctgtgggtccaatggggcctgctggtccaaaaggaaatgatggagctccaggtgctaggggagagaaaggtgaaactggcccagcgggtccagcaggtcctgcgggtccagtaggtcctagaggcgaaacaggtcctaggggtgagaaaggtgatacgggtcaaacggggccagcaggggctgctggtccagcaggaccacaaggtgcaacaggaccacaaggcccagcgggagagccaggcaagcaggggcctaggggggataaaggcgaaactggccctgcgggtccagcaggaccacgaggtgcacctggtcctgcgggtccagcaggtgcaactggccctgcaggtccagcagggcctagaggcgaacaagggcttccaggggtagcaggtcctaggggtgagcgaggcgaagctggtcctgctggtccagcaggaccacgaggaccgcagggtgagcgaggagaaactggctctgcaggtgcaactggacctacgggtccaatgggaccacgaggaccgcaaggaataccgggtactccgggacagaagggggataaaggcgaaccaggacaagcgggtccagcaggaccacgaggccctgtgggtcctaaaggtgatgcaggtcctagaggcgaagctggtccagtgggtccagtaggaccacaaggtgcaataggccctgcgggtccagcaggggctaagggtgacaaaggtgatacgggtcctgcgggtccaacgggatcacaaggccctgcgggtccagtggggcctaggggtgaaccgggtcctgaaggtaagcaaggtattcaaggacctgcgggtccaacgggaccacaaggatcgcaaggaatagcgggtactcagggacctaagggggataaaggcgatccaggacaagcggggccagtgggtccagcgggaccacgaggccctgcgggtccagcaggggctaagggtgagcaaggagaaactggtcctgcgggtcctaggggtgaacagggtcctgaaggcaagcaaggtattcaaggacctgcgggtccaacgggaccacaaggatcgcaaggaatagcaggtactcagggacctaagggggataaaggcgatccaggacaagcggggccagtgggtccagcgggaccacgaggccctgcgggtccagcaggggctaagggtgagcaaggagaaactggtcctgcgggtcctaggggtgaacagggtcctgaaggcaagcaaggtattcaaggacctgcgggtccaacgggaccacaaggatcgcaaggaatagcaggtactcagggacctaagggggataaaggcgatccaggacaagcgggtcctaaaggagaaaaaggagatacaggtcctagaggcgaacaagggcttccaggggtagcaggtcctaagggcgatagaggcgaagctggtccagtgggtccagcaggaccacaaggaccgcagggaacagcgggtgcaaatggtcagaatatttacaatatgagcgtgtctggagatttaagcgacattacttcaattagtaatggcgatactaaggtatctttaggtaaagatgagaaaggaaatccagttgtaaatatgaatggatcaagaattaccaatataagcgatggtagagaagagggagatgcagtgaatgtgcgtcaactaaacaaagtggtttcttctgtgaatacaggatttaatcaattatcaagagatattggtcgtgttgatgttaatgcaagagcggggattgcttctgctggggcgatggctaatttgccacaaatttatttaccaggtaaaagtgctatttctgtttctagtgcacaatatcgcgggcaatctgcctatgctataggttattccagaacttctgataatggcaaatggcttattcgagcgtctgttagcagtaatacccagcgggatactatgattggaggaggggcaagttttgtgtggtaatctagcacctataaattagaatttcatgctcaatgccattgttattttaacaatggcattgtttggcgtagtagacaaaagtgttggttttaattattttccctaattattaccaactctttttatttaaaaaatcctttataaacataatcttatgctttttcgttaatccattatgaaccgataatttctgtttcagttctttaaataacccttccaacctatttgttgttttttctatatttaagtgagcatattcttcaaaagtgagcttaaagccttgtactataaggctttagcccactttttaccaacacttttgtctactatgcctaggacaatcccaataaaaataaggcattatcttacaaaatattaaggctgtgaatcacagccttaataaattatgcttcttcaacagataaattttctataccgtcgtcttcaatttcacagattcgttcaaggctgacaacatgttcgtcttctgcggtacgaataatacgaacaccttgggtattacgtcctacaaggctgacttcgtttacacgggtacgtactaatgtaccggcatcggtaatcaacataatttggtcattttcttcaacctgaactgctgcaaccactttaccgttacgttcattcactttaattgaaactaccccttttgttgcacgagatttgaccggatactcacctaaggcagtacgtttaccataaccgttttgggtaacggttaagatttcaccttgagtatgtggaattacaagggaaaccactttatcggtggttaagttaacacttgaggcttcttcagcttcttcgttttcaacagtttcaatatcgacttcttcagcatcatcgactgaaatttcggttgttgctaatttaatacctcgaacccctgttgcaacacgccccattccccgcactgcagtttctgcaaagcgtaccactcgaccttgcgccgagaacaacatgatttcactctcgccattggtaatatctaccccgattaattcatcaccctcgcgaagttttaatgcaattagaccgcttgatctaacattactaaatgcatcgagcgaaacttttttcaccgtaccactcgccgttgccataaaaataaatttatcagcgctaaattcaccatttggaacgggaagaattgcagtgatacgctcattctcctcttttacaagtggaagaatatttacgattggcgtacctcttgcaccacggcttgcctgtggtaattgatagacttttaattgatataaacgaccacagcttgagaagcagagaatggtatcatgagtattagcgaccaataatttttcaatgaaatcatcctctttcattttcgttgctgatttacctttaccaccacgacgttgtgcttcgtaatccgataacggctgatatttcacataaccagcgtgcgataaggtcacaactacatcttcttgagcaattaaatcttctaaattaatatcgcctgaagccgcagtaatttcagtgcgacgctcatcgccaaattcggctttgattttttcaagctcttcacggatgacttccattaaacgctctgagctatttaaaatgtgtaataactcgctgatttctaccaataattctttgtattcgtctacgattttttcgtgttctaagcctgttaagcggtgcaagcgaagctctagaattgcacgagcttggccttccgataaataatattgcccgtcacgtacgccgaattcagaggctaaatcttctggacgagaagcatctacacccgctgcttcaagcattggtgcaacattacctaacgaccacggacgatccaataaaccttcacgtgcttcatcggcagttttggaatttcgaatcagctcaatcacaggatctatattggctaatgcaatcgctagaccttctaaaatatgtgcacgttcacgtgctttacgcaattcaaagactgtacggcgtgttacaacttcacgacggtgcatcacgaaagcttcaataatctgtttgagattgaaaatttttggctgaccatgatcgagtgccaccatattgataccgaaagtcacttgcatttgtgttagagcgtacaaattattgagtaccacttcaccaacagcattatttttgatttcaataacaatcgaaatcccttttttatcagaatagtcttcaatacttgaaataccttcaatacgcttatcacgcaccaattcggcaattttttcgattaaattctttttattaacttgatacggcaattccgtgacgacaatctgctcacggccttttgaagttgtttcaacactggctttggctcgtacatacactttgccacgacctgtacgataagcatcttcaatccctttacgaccattaataatcgccgccgttgggaaatcaggaccgggaatatgttgcatcaactcttcaatcgtaatttgttcgttttcaatataagctaagcaaccgtttaacacttcatttaggttatgaggaggaatattggttgccatacccacggcgattcccgaagaaccattaacaagcaatgccggaattttagtcggtaatacatcagggatcatctctttaccatcatagtttggagagaaatccactgtttctttatccaaatccgttaacaattcttgcgtaatcttctgcatacgcacttcggtataacgcattgccgcaggcgcatccccgtcaatcgaaccaaagttcccttgaccatctaccaacatataacgaagagagaacggctgagccatacgcacaatcgtataatacaccgcaaaatcaccgtgagggtgatatttaccgatcacatcaccgactacacgtgccgatttcacataaggtttagatgatacgttaccgctttgatccatagaaaaaagtacgcgtcgatgaacgggcttcaaaccatctcgcacatctggtaacgctcgcccaacaatcacagacattgcataatcaagataggaattttttagttcctcttcaatactgataggaataatatctttagccaattcactcattaaaatttcctaattgcgttgtaaacatacctaattatttctataagctattcaattattaagtgaaaaccttctatagaaagaaggttaattataacattttaaataatcaacttcaatacaaaagttaattatttttaagataaaaaaacatataaaatatattacgaacttacttttaatagtgataaatttagaattatttttaataggaggatcaataaatataagatataatatttaatatcaattttttatcaaagtattttcaatcataagaatataaaaccatttaaattaaagcatattccattacctaagtatcattttacagaaggaatcatgtcatttccagaatacaaaactctatgcgattatttaaaggaatataatttacgttattactttattgtaaggttcttaggaagcactggagctagaataagtgaactagtaaaattcacaatacaagatttagaaaaaggatatgctgaatgccattctaaaggaaaatttagaagaattaatattcctcaaagcctgattaatgaatctcgtgaatttttcaaaatcataaaaaagaattattcctgaatagatatggagcacctatttcagctagaggtattgctcataatttgaaaatatacgcagaaaagtgtggcatcagaaaagatgttgtccaccctcataattttaggcatttctttgctatacaatttttaaagaaaaataataatattgctttattagccgatctgttagggcattcaaatgtaaatatgactgctttatatctaagactatctcattcagaacaacgtgaggctataaataattcagtgaattggtaatttattatatactacttcatataggcttatttctatataaaaaatggcaatatagatttatatattgccatttccaatattactattttaattagcctttgtagttgtaaatgtgagcaactaagtctaatactttgtttgagtaaccagtttcgttgtcataccaagaaacaagtttcacgaatgtatctgttaatgcgatacctgcatctgcatcaaatacagaagtttcaactgcaccgttgaagtctgttgatactactgcatcttcagtataacctaaaacgccttttaattcgccgttgaatgttttaccttctgctgcatctttgatcgcttttttgatctcttcgtagcttgctggtttttctaagtttacagttaaatcaacaacagatacgtttgctgttggaacacggaacgccatacctgttaatttaccgtttaatgctggtaatactttacctactgctttcgctgcacctgttgaagatggaatgatgttttgtgccgcaccacgaccaccgcgccagtcttttgctgatggaccatcaacagttttttgtgttgctgttgttgcatgaacagttgtcattaaaccttctttgataccaaatgtttcgtggataacacgagcaagtggtgctaagcagtttgttgtacaagaagcgttagaaacgatgtcttgaccagcataagcgttgaagtttacaccgtttacgaacataggtgtgctatctttagatggaccagttaaaacgacttttttcgcaccagcttcgatgtgtttacgagcagttgtatcgtctaagaataaacctgttgcttcaactgcgatatccacaccaatttcattccattttaagttagctgggtcacgctcagaagtaacacggatttctttaccgtttacaactaatttgccgtcttttacttcgacagtgccatcgaaacgaccgtgagttgaatcgtatttgagcatatatgccatatactcaacatcaattaagtcgttgataccaactacttcgatgtcatcacgtttttgtgctgcacggaatacgatacgaccgatacggccaaagccgttaataccaattttaattgccatagattttctacctatattaaagttaaacaaaatttgttctttcctagacattggaaaagcgagaggattataacacaatctttcccttttctgacaactaaagaacagagcaaaatatagcagataaattttatgtgatctatgtcaaattttttaaaaccctctcttgcttttaactaaaaaaagttagaataattggtaacaaaccaataagagaaaaggatttaaaatgattaaagatattagtgaattaaccgaagaacagattgaaatttgtttaaatgcaggtacagaaaaacctttcagtggtaagttcctaaaagaaaatagggtggggacatatcgctgtgttcgttgccataatgcgttatttcgttctgatgccaaatttgatgctggttgtggctggccaagtttttatgaaacgatctcggagtcttcattacgttatgtagatgattatagtttaggcagacatcgtgttgagattcgctgtggcaattgtgatgcccatatgggacacgtttttaaagatgggcctcaacctacaggattacgcttctgcttaaattctattgcattaaactttaagtgggatcaaactggtgaagaaatagatgggtaaaataaagtataaaagtttctcggcataataaaaatgcccgcttttgcgggcattttttaagtttcttggattcaaaagtgattacatagaaacttcttttgaaccttgaacttggatttcaacacggcgatctggtgctaagcaaacgattaatgctttacgacctttaactgcgtcacatgtgttaccagttactgggttagcttcaccgtaacctaccgctgttacgttagctgggttaacacctttagaaacgatgtagtttgctactgtttctgcacgtttttgtgaaagagttaagttggcagcatctttaccaatacggtctgtgtaaccgtttacttgtacagcagggtttgctaaacctaaatttacgatctcagtgtgtgctgcgtctaatgtttgtgctgcagctggttttaagttcgctttaccgaagtcaaataatacatctgagctgaacgcgaagtttttagttacaacttctggtgctgctgcaactggtgctgcaccttgaccaaagcgatatgaaatgcctgcggtcacagaatgagaatctgggctatagttgtaagttgctctacgattctctttcatttcagctttagtgaagttacctacattgctcaaccattgatattcaacacggaaagctaattcaggaagaatcgcatactcaacacctgcaccaacgattaatgaagtttttaagttatgcgatttaactggttctcttgtttggaagtaacgtttgtaatcattacgaactaatgcagcaccaactttaccgtaaacatctaaaccgcttaatacttcatagcttggttttaagcttaagtgtgtaccgtgtgcagagtgtttgaattcacggaattcttgtttgttaccacgaacacgaccgaaataatcgtaacctaattcaactgctaagttgtcgatgatttggtaaccgccaaacacaccgtaagttacagagttacggttaataccgtatccattagcgctagttgcataacgagcatcgttcttatatttagagtttaattggttaatatcattgtggaatgttgcccaacctgctttagcaccaacatagaaagagtcagcttgtggagctgcgtttgctactgatgcaactgctaaacctgatactgctaatgcaattaaagattttttcattttgatgatcctctattatcgtcatctaattaaacaaaattcttagcgtaatcattacgctaaggctttaattacgctttctatccttcaatacgaaaagaaagtcggaatttagattatattttactaaaaaaaatccgaaattcaagcgaactttttcaaagaaactgtttcaaggctgaaatttcttacattcctgtcttttctttcttaaagatcgaggcaaaaatatgcttattatcccattaacgtaaaagaaatcaatttataagcattcaaggatatgtaagtaaatgtaataaattgcaactttttaaatgctttgctaatttttttgtagtaattttcattaaatgaaaatcttgctaatatctcgttaaaattttaacagattaaaaaaactatgatcccacgccttgcaaacatcccccaactgaatccacttgttcagcaatatttagctgaactcaaacagcaacatttcagcggtgatattgcgtcaaactatgctgatcgcctttctcttaccaccgacaacagcgtctatcagcaactgccccaagcgattttgtttccgaaatccgttgctgatgtggtgattttaaccaaactggcacaaaaaaccgcattccaagccttaacctttaccccgcgtggtggcggtactggcacgaacgggcaatcgctgaacaataatatcattgtcgatctctctcgccatttaacgcaaattttggaactgaatgtacaagagcgttgggtgcgagtgcaagctggcgtggtgaaagatcagcttaatcaatttctcaaaccgcacgggctattcttttcccctgagctttcaaccagcaaccgagcaaccttaggcggaatgatcaacacagacgcttcggggcaaggttcgttgcaatacggcaagacttccgatcatattttggcgattaaagcggtgttgatgaacggcgatattttggaaacacaagcggtcaaaaccgataatttttttgcaaatgtcgatcaacttaatctcacggcaaatggtaaaaaattacatagcgagatcttccaacgttgccaagcgttacgcccgaccgtgctgaaagaactaccgcaactgaaccgctttttgacgggttatgatctgaaaaatgtgtttaacgacgatctctccgaatttaatttaacccgtattctcactggctccgaaggttctcttgcctttatttgcgaagctaagctcaatcttcttccgcttcctgaataccgcacgctgattaacattaaatataattcctttgatgcggcgttacgttccgccccttttatgttgcaagcccaagcactatcggttgaaacggtggactccaaagtgctgaaccttgccaaacaagatattgtgtggcattcggtatcggatctgctcactgaagatgaacacaatccgattttggggattaacattgttgaatatgcttcaaatgataaggctcagaatgaagcgcggattgccaagctgtgccaagctctagatgaaaaaatccaagacggcacaagcggtatcatcggctaccaactttgcaacgatttggcttcgattgaaaaaatttatgcaatgcggaaaaaagcagtcggtttgctgggcaacgcaaaaggttgggcaaaaccgatcgctttcgtggaagatacctgcgtaccgcctgaacatttggcagattatattgtggaatttcgccaactgctcgacgagcacggtttggattacggtatgttcggacacgtcgatgcaggggtgttgcacgttcgtcctgcccttgatttatgcgacaaagcacaggttgccaaattcaaagcgatttccgaccaagtggttgaattgactgcaaaatacggcggtttgatttggggtgaacacggcaaaggtatgcgttctgcctatggcgagcggttcttcggcgaaaccttatggaaagagttgcgttatatcaaacagcttttcgatccgcaaaaccgcttgaacccgggtaaaatctgtacgccgttagatagccaagccagcctttatccgattgactcgcaaatgcgtgccgatctagacagacaaattcctattcaagtgcgagaagcctttaaaggggcaatgaattgcaacggcaacggtttgtgcttcaattttgatgtacacagtacaatgtgtccgtcaatgaaagtgtcgggcaaccgcctattttcaccgaaaggaagagcaacgttagtgcgtgaatggctacgtttactggcggaacaaaatgtttcccctgatgagttgatctttgaaaaacagcaaacatcggcgaaattagtcgattttgcgaagaaaatccgtaatcagtggcgaaaatcacaagagtatgatttctcccacgaagtgaaatcggcaatggatacttgccttgcttgtaaagcctgtgccagccaatgtccgataaaaattgatgtaccaacgttccgttcacaatttaacgaactttatcaccgccgttacctgcgtccgctgaaagattatgtggtggcaaacctcgaatttgttgcaccgataatggcaaaacagccgaagttgtttaactttttcagtgccaacaaactggctgaaaccgttgtaagtaaaaccatcggaatggtcgatctaccagccttatccgtgccgacattacagcaacagttagttgaaatcggctatcaaggcaaaaccttggaagaactagaacagcttgcgacaagcggtcagttagacacagaaatttgcaaatatgtccttgtggtacaagatcccttcacctcttattatgatgccaaagtggtggcggactttgttcagctcgcccaaaaactcggtttcaaagcgattgtgttgccgttcaacccaacgggtaaagctcaacacatcaaaggctttttacacaagtttgccaacaccgctcgtacacaagccgaattgttaaaccgtgttgccaaattaggcattgcaatggttggcgttgatcctgccttaaccttgatttaccgtgaagaatatcgccaaattttaaaagacgactgtggcgaatttaaggtgttactggctcacgaatggctgttggctcaactgaaaaacggttctctagaccattgcaaaaaatcagccgaaaccgatcgcttaccgtggcatttatttgcacactgtaccgaaagcacctcgcttccaaacagcttgaaagagtggcaacagattttcgcccatttcggcgaaaccttaacggcggaaaatatcggctgttgcggaatggcaggcacattcggacacgaaaccaagcaccttgcaatgtcaaaagggatttacgcacaatcgtggcaagttaagttgcaaggcaaaaccttatcccgttgccttgccactggctactcttgccgtagccaagtgaaacgaatggaacatcagctactcaaacaccctgtgcaagcattgttggaagtgatttgacctagataaaaaataggcataaaataaaaacaggaacggcggtcaccgttcctgctcggtttcactgcttagccagcgctacccttaagtaacaggcatagcagaataacaattaaccacaaaagagtgcgtttcattgtttttatctccacggataacattaaacgtaaagatctactaaaacagctcgctaggtgcttactggcggactgatttttcgcagatccgcctctgttttattatgtttaaacaataaaacattgggaaaaattatacacaaagcctgtttatttgaacaggcttttgttttatctatatacggaaaacacaaaatgatttggaaaaaaaacacaacaattgagcaacttaatcaactctgccaacactctgctatttcgcatttaggcattgaatttaccgctcagcaaaacgatagtctagaagcgaccgtgcctgtcgatcaccgcacaacacagccattcggcttattacatggcggtatttctgcgactttagcggaaaccttaggctctgcagctgcattactttgctgtgaagaaaaccaaatccctgtcggtacagaattgaatatcagccatttaaaagcgataaaaagcggaaaagccacgggcagagcaacaccgttacatttaggcaaagagagccaagtgtggcaggtggaaattcgagatgatgcacaacagttatgtgccgtggcaagattaagtattaagctactctcccaaagataaaaacaaagccccaaacgaccctatcccaaattctgtgtaaacacccatttcaacttaacggtgatcgtctaggcgatcaccaaaatcaatcataaatcgattcatcgccagtttccagttctgaatcggcattgtccatttttttgatacatctttaatcgcaagccaaatcactttgaaaactgaatcatccgtcgggaatacatttcgttttttaatcacgcgacgaatcacgctattaagcgattccacggcattcgtggtataaatcgctttacgaatatcagccggataatcaaaaaatgtggcaatatttgcccagttatcttcccagcctttcgccacaagcgggtattttgcctgccatttttgcgaaagtgcggtcagattttcgcgagcctgtgcttccgtcggggcttgataaacctgctttaaatatgcagtgacggctttgtaatctttccacgaaacgaatttcaagctgttacgcactaaatgcacaatgcaaagctgaaactacgatacaatctaggtaaacaattggataaaccgcatcaagtgggcgattttgccatgccattacgcgctctttcacggcgtcggtaacgcgagaaatcaggctggttgatacatccgcatcatagagttctttgaacatttcaacgatttcctgattacttaaccccttggcatataaggcaataatctgctcatccattcctgtgatgcgggtttggtttttcttgataagttgcggttcaaaggtgccgtcacggtcacgaggcgtctcaatttctatctcaccttcatcacaaatgacagtcttagatgtgtaaccgttacgtgcatttttaccttttctaggctgatgtttttcataaccaagatggtcggtcagttcaccatttaacgcagcctcgacggtgatttttttgagcatccgtgaaaattgattgaggtcttctggtgtttttaggtttttggcaaattccgctgccaaggcgtgaagttgtttttcgttcataattaaaatacctgtgtctgaatgtattatctcagaaacaggtatttacacaaattgtgggagaggctcttgctaatatctattttctttaaatattagcaactctttttattaaaaaatcctgtataaacaacatcttatgttttttagttaatccattgtgattatttaattttcgcttaagttcactaaataatccttctaagcgatttgtcgttttttctatatttaattcagaatgtttttcataggtaaaaatataatccatataacgtattaaactggcataaacacttctttcattgcgatgtttataaggaaaatagcctttttcattggctttattactcctttcttttaaaaacacttggtactttatgaaccaagaatgtaatcgccgataaaattcattttttgagctttttgtgagtgtttttgtaattatttttaattctttacccacttgtgattgatgtttttttcttaatttacgcatcacaattgccaccatatgaaattgacacatctgtaccggcgtattaaataaatctttcatcaaacctcgcctaccatcgcaagtaattgattgaattatatagcctttttctcttaacctattcagggcaagtttgtagtaaatatctttttcggttcgcacaaaataatgggaaatcacattatttgaattagaatccattagcactaatacgccaaaataacgacagaaaaacgttgtatccataatgatgttcaggtatctatttgaagtcggttttaaagctgttttaggcgctttatcaatatatctttgaatcgttctgactgaacaatgatatttaacagcaagttgttgataggtttgttttccggatgtgtaatcagtccaaatttttattggatctaatttattcttaagggaaaatattttatgacacttatgacaaaatatcgttgaatattatttgatgtaccatgtttctttattttcagactttggaaaaatgggcagttttttgttcacatttcaaaaagagggcctaaaaccttgtactatagggctttaagccactttttagcaacaaatttgtctattacaccagtaaatatcgcacaggacattaaagaaactgcaaccttattgaggaaaattaattatccctcttatacagtaatgatttgattttttaatgtctgctattaacatctcacggttagagcaatctaaccgtgagatgttaatagctatactcaggaagactctaaaatataggagtttttaatatagaaactaagatagatgttctaaaaatgctggcaaattttgagcccctacttgttgagctacgacttctccatttttaaaaatcaataaaaatggaatactacgaacaccaaattctgctggaatctgctgattttcatcaacattcatcttcacaatacgagccttatttccaagatttatggctaaatcatctaatactggaccaattgctcggcaaggaccacaccaaggagcccaaaaatctaataatactgggacatccgattttaatacatcttgttcaaaagatgcgtcagttgtatgaattactgtactcataatttttccttaactaaaataaaaaagaaacgcttctataacatctaaagcgttaagacgtgcacaagatagtgctttattcctgacttttcaagtaggaattaagtattaatgtaattaattttacctagcgtgctatgaagttttatacttagggaaatttccactatgtataagaatactaaacggcaaatcctcatatagttcagtgaataactaacacattgatacattatatcttatttacaacatttttatgggacatatctgttgatgcctttgtctaccttacaaatttaggagaatatccataggctaaataccccctcatacaccaatttccccccaaataaaataaacactgccccagcaaaattatctagatagcggttatatttcgcataaaaatggcgaatagctggtcgagaaaatagcaaagcgacaagccagaaataaaccactgcactgcccactaaaatggcaagtaccgcaagtaagtccgctaatgcagagagattagcaacataaccagctaaaacactgctgaaaaataccacaattttagggttggcaaggttaatcattaacccttttagaatttctttaacggcagaagttgtttgtgatgttgatgttgccgagccaatttccgcatttttcgtgatttgcaccatttgaatgccactataagcaagatagcttccgccacaaatcatcagcacaaattgaaatgaagggaaatgtttattaagaaatgccaagccaaacaaagtgagtaatgcccaaaatgcaacaccgatagagataccgatagcacctaaaatcgcatttcggcgagtgtctgccattgctttacggctgacatagaaaaaatcagggccggggctaattaagccgagtaattgtacgaaaaaaattgtccacattttaaatgcaccaagagatcaaatagagagcaataatggagtagagtgccgctaaaatatcatcaaacataatgcctaatccgccttgcagatgttcatcaaaatagcggatcgggtagggtttgagaatatcaaatatacgaaaagtaacaaaggtcagcagataatagagccagtgatgttcaggtagaaaacagaagatcacaaacaccgcaacaatctcgtcccaaacgatccgcccatcatcgtgtacgccaagatcgtgactggttttgtcacagatatagcacccagcaataaaagtgatcaaactaagtaacataaaaaagagcctgctttctgtgatatgccacaacaagatcgcaacccctaaaccagctaaagttccccaagtgcctggggcaggtttgatcagccctgaaccaaagccgaaagcaagaaaatgaataggattttttaaatttatcttcattgttaattaaaatgatcaaagccaatttgattaggctgtggataaacagagccgtgttttagtaaggtcaaacgaccgcttgtttcggtgattttaccaatgcaatgacaaggaatgcctaaatcagcaactgcttgttccattgcagagcgattttcttccgacacggtaaaacagagttcgtaatcttccccacccgttaaagcaaattgttctgcctgttcttgtaaataagtctgcaacagtggtgctgaaagcggtaacttatccacattaatttccgcaccgcaactacttcgctctaaaatatgccctaaatctgccaacaatccatcggaaatatcaatggcacattgtgcgtagttgagcaaatattgtcctaatgccactcttggcgttgggcgtaaatgacgttggattaagtagtgctgagcgtcggttaatatggctggcggatcgagcaacaaggctaaccctgccgagctatcgcctaaataccctgaaacatagataagatcgcctacctttgctttatgacggaataaccctttgcctttgggtagaaagccttgtgcggtcaaagtgatcgctaagtgacctttggtggtatcaccgccgattaaagcggtttgatgatcggctaaaatagcaaaaagcgattgactaaagctatcaagccattgatgatcaacttcggataaggttaatgccaaggaaacccaagctggttttgctcccattgaagcgagatcgctcagattgaccgcaacggatttataagctaaatcagcaggggaaatcgtaggaagaaaatgcgtaccaaggactaaggtgtccgtcgtaatggcgagttgatgatccgttggaacttcggtcactgcacaatcatcgcccacggaaagtaaaatatcctggcgatctaaccgcttgtcacggctaaaatagtgctttatcaaatcaaactcgcccattgtaatccttatttgcggttcaacgcaggggctaatttatctaatacgccattgacatatttgtggctatcgtcagaaccgaatacttttgccacttcaattgcttcattaattgccactttgtaaggcacgtctaattcaaattttagttcatagccggctaaacgtaagatcgtacgttcaatcggatctagttcattatccgcacgatctaaatatggacgaagaatatcatcaatagcatctacattttctactgtaccgcgtaataatttacggaaataaggcatatctacgccttgcatatcttgatcggtcacaaaggctaattcaacttgttcaatgttattttgcgaaatgtaccacgaataaagtgcttgtaccgcacattctctcgcacgacgacggggagaaactttcataaaacctcaatttatcgaaatgaaaatagtcgacaattctagcacattgtagccttttcccgcaaaataaaggtgaagttatttctgcttttccgctcctattttttcagatttcacaatataaggcgtgacaaaaatcactaattctcgtttagagattttatcttggctttggctaaataagcgtttaatcacggggatactgcctaacagcggtactttatcttcgcctttggcgatcagatgttgaaaaataccgcctaatacgatggtttcaccgtgtttagctagaacttgcgttttgatttcctgtttatcaattgtcaccattgtattatttatttggttattgggcgaattttggctgatagcaaggtctaacaaaatctgattttgtttagaaatatgtggcgtgacctctaaccccaaaacggcttcacgaaattcaatatcggtgatttcctctttcttactgtacattgcataaggaatttctgtaccttgtttgatactcgctgtttttttatctgttgtgagtaagcgagggcttgcaatgatctctatgttattttcgctttctaatgcagtaagttctaaatcaagtacacggctgttgattgcagcaatttgtaaggcaacagaagcggacggatttactggaaaatttacgtttaagttgttggtagttaatccgttgccttctaaattgcctgccaatttgtagtgattttcgttaggggaaaataagccccaacgcacgccaagttgttgtaaatgttcactgctgatagtgacaattcgggcttcaattgcaatttgttccgttggtttatctaggctttcgataagttgagtaaagtttttaactgaggcggcactgtctttgacgataatgctattactgcgatcatcaaagtgaagataaccactttctgatagtaaattgccttgcccttttgttaaagactctataacttcagaggctttggaatagtgtaacttgattgttttggtgattaatttaggcagagcattaactaattgtgccgtagtatgttgtttatgttcttgggcttgatgaatatagtaaatgccattttctttttttaaatttaattgatgtgttttgattaaactatttaatatctcatcaaaatggcttttttctactctgaaattttttgtatctttaatttcatccgaaattgtaatattctttcccgtttcctccgccaaataactaataatctctgccgttggggcatttcttatcgaaagtgaaatttgttggtttgctaatacaggaaaagtagcaaagaagagcagaaataaataacgcataagatactcctaaaattttgaagtaaacaatttaggagattggcaattttctgttttttgccaatcaatataactaacagatttaaaattaatttctttaatttgaataaaggaatggcttaaatagtcgtcaggatataaatctataagctgttttttatcatctaaaaaaatggctcggattttatcgtcaatctgaataatgccgataagctgtaatttatcaaaatctttggtgagattaatttcattcaccttatccgttggcatacaagcggtcgttttgttttgatcttttgccgtttgtggctgatcttgggcgttatccttagcataaaaaggatctgccatagtgacagcacttagaaagataaaatagaaaaagcataatcgcattagggttctcctgtgtcagcttgaaaaagcaaagtggcattgagttgaatatgtttctgttttgtttttttagttaaatggatttcctgaaatttaactgtggttaattgattaagatcagcaatcacattaagtaccttttgcgtagattggctgattaataaatagatttttctttcttccatattccattgaatactgtcaatttctacgctgtttttatccaagattttttgaatttgttgatttatttgggttaataattcacttttatcttgagcaagttgataacgttgttgtaataattttaattgttgctgtttatgttcgttaatctgtttaaattcagtgagctgtttttgttgttgagctatttgctgattaagataaagataatttcctattggaaatgccataattaacaaaaatattcccgatagaataaatattttattttggtttaaataatataaaccacgatataatggatgttgtggcattaaataatacttggctaaggacaatttcattctttttcctttaaatcaatatgtaggctaaattcaatctcgcttttttcacgcgtttcaaattgttctatttgataaatgtaattcattgcttttaattgttgttcaagctcgctaaattgagtagggctagacactttgcctttgagtttaaagacggtattttctgcttggtatagttgggctatctcaataattcctgataattgaatgcctaacagataattcaaaaatgcggtaatctgcctattttctaggctttgtctgcttttattctgtgattgcaaagtcagttgttcaatctgctggcttaatgtggtttgttgctcttggctttgttgtcgctgttgagccaaagtgtgaaattgatgttgttgctgttgattttgccaactgataagtaacgccagtagtgtgctaaccacaaaacaagcggtgagatgcttgaggtttttttgcgactgtttcaaccattgctgttggcggtagccatttagattgatgccttgccattccataaacttgctcctaatgcaatgagataaggataaaagtggggaagatgttgagcttggggcaagccgtccacttcaatgattggtttggtgctattattctgcttttcgacgataattcgttgattttgaaagtgaataaatttgtcttgaatgtggaaactgtgttcaagaatttgcgtttccgtcatttttgtcagaaatcctaccgctcgtagcaggcagtagagttcgcaatctaaaatagctgttgggtcaaagctgttgctttttcttagagcatatagattaagctggcaaaggtggctttcggctaaaggggtaatgtggtaatcaatgtttacttcagataaagctaaaggtaggctctgtttgagtacacgaatgatttgctcagcttgttttaaatgggaatgtagctccggcagtatcaaggtttttcgccaaatatgctgatgagaaatgccttgaataagctgatagttaaagggaaattgttgtaggaaactatccgcttctactttgcttgaaaagtaaaaggtgtgaggttgttcttgctcaaaatagacgatacaagcggtattttcttgccagaaaaaaccaacttgaataggtttgagttgcggtgttgtacgaaattgaaagaatttacccatatttccctcgaataaaaaatagattatgaggtcaattaaaactataattactcgtttctacctcactgatgtataagcagagggcagttttcggatttaggttatcttgacctagaattatcctttcgtcatttagcaaaagagaatttttcgatgaagatcgtaaaaatcatatttagtgctttacttacactaataattgtgggtctagttgctgtaggttttctttatgttcatttaaaagaagatttacctgatgtagcaagcctaaaaaccgttgaacttcaacaacctatgcagatttttaccgctgacggtaaactcattggggaagtcggggagcaacgccgtattcctgtgaaacttgccgatattccgcaaaccttaattgatgcgattattgcgacagaagatacccgtttttatgaacataaggggatcgatcctaaaggtattatgcgtgccgtttggcgttcaagccaaggagatacgcaaggggcgagtaccattacgcaacagttagcgcgcaactttttcctttcgccagaacgcaaacttgagcgtaaattaaaagaagtgattttggcgttagaaattgaagaaaatctgtctaagaatgagattttagagttatatctcaataaaatttacttggggtatcgctcttatggggtggcggctgcggctaaaacctattttggtaaaaagctagaagaattaacgctatcggaaatggcgatcattgcagggctaccaaaagccccttccacgatgaaccctcttttctcgcttaaacgagcagaagctcgtcgtaatgtagtgcttgggcgtatgttagaagtcggaaaaatcaccaaagctcagtatgaacaggctaaagcagaaccgattaaagccaaatattacggcgctgcattagaatttcgcgccgactatgtgacagaaatgatccgtcaagaaatggtaaaacgttatggtgaagaagtcgcttacaccaaaggtttccaagtgtttgcaacagtgttatcagctgaccaaaaagaagcacaagatgcactacgcaataacttgattgactacgaccgccgtcacggctggcgtggagctgagaaactgtggaaccctaaagagaatgcgtgggacgaagaaaagatcatcgatcacttaagcaaattgccaagctctgagccatttacaagtgcggcagtattggcaatttcaaaagataaagcgaatgtgatgttgccaacaggggaacgtgttgagcttaagatgtctggaatgcgttgggcaagaaaatttatcaatgactccgcccaaggcaaagcacctactcaagtaaaagacgcgatcaatgttggtgaacaaatttgggtgcatcaaaatagtaagggtgaatgggaattagggcaaattccagatgtaaactctgcactggtttcactaaatagtgataacggggcgatagaagcgattgtgggcggtttcagttttgaacaaagccgttttaatcgtgcaacacaatctttagtgcaagtgggttcttcgattaaaccttttatctatgctgcagcattaaataaagggttgagcctttcaaccactctaagcgacacgcctattactattacaaaagcaggacaaaaaccgtggacaccgaaaaattcaccgaatgtgtatgaaggttcgttacgtttgcgagtaggcttgggtaagtcgaaaaatgtaatgatggtgcgtacagttcagatggctggcgtagagtatgtagcggattacttacaacgctttggcttccaaaaagatcaatatcaagcgacagaagcattggcattaggggcagcatccttcacgccgttagaaatggctaggggatatgccgtgtttgataatggtggctatttaattgaaccttatatcattgaccgtattttagatagtgcaggcaatgaactctttaaagcaaaccctgcaattgcctgtttagaatgtgatgataagccagtcatttatccagagccaacctattttgattttgtcaaagtaaaggaaaccacagaagaaactgtaattcctaaagatgatgaaagtgatgttattcctgaactggatattgccactaaaaccaaacagaatgccccaagcttgatggcagatgccatagctgttaatcgagaagtgcattatgccccaagggttatcagtggggaaattgcgttcttaatgcgaagtgcattaaaaacagccattacaggtgaagctagtcaaggctggaaagggacaagctggcgtgtggcaaatgagatcaagcgcagtgatattggaggaaaaacagggactacaaataacgcaaaaatcgcttggtacgcaggctttggttcaaacctcgtgacgacagtttatgttggttttgatgataataaacgtgaattgggacgtggtgaggctggcgctcaaacagcgttgccggcgtggattaagtatatgaaagtggctctttcggataaagaagagcgaaaagaacagttaccacctaatatcatagaattacaaattgagcctacaagcggtctattagggggaaatatgaacgaatacttcattaaaggaactgaacctaagaaacgttatattgtagagaaggcacttgaacaacctctaggtacaaatcctgaaggaactgaaaaaatcagtaaagaattattctaaaattcgataattctctttgttccagttgaaaagtagggcgatttattgagataatatcgcccatctttattttgggcgatttgtggtaaatttataagataagtgttttaattttaatcacttttacaaaattcaacataaaacagaccgcttgtatgtgcaagcggtctgttttttctaaaaattcacaaatcaatttttcactctatttttatttatagaacaaataatggcagaaaaacgtaatatctttctaattggccctatgggtgcaggtaaaagcacgattggtcgtcaattagcacaaatgttaaatatggattttttagactcagacgctgtgattgaagagcgtgctggggcagatattgattggatcttcgatattgaaggtgaagctggtttccgtaagcgtgaagagcgtatcattaatgagttgacacaatctcaaggtcttgtgctttcgacgggcggtggttcggtgttgtctaaagataaccgcaatgtgctttcagctcgtggtattgtggtttatcttgaaactacggtggataaacagtttgagcgtactcaacgtgataaaaaacgtccgttattacaaacggaagatccatatcaaacgttagttgaattggcgaaaattcgtaatccgctttacgaagaaattgcggacattattttgcaaactgatgaacaaagtgcaaaagtagtcgcaacgcaaatcattgatatgattgataatttacagtaatcagggaagtctatatgttgcaagttaatgtggaattaaaagaacgtcgctatcctatcgcaataggggcagggttattaacggatccgatgagttatcacccgttaaaatcaggggataaggtgatgatcgtgtctaatccaacggttgcttcccattatcttgcaacagtagaacaaacgctaacagctatcggttgtaaagttgattcggttttaattcccgatggcgagcaatataaaaaccttgactcactcaatcttatttttaccgcattacttgaaaaaaatcacaatcgtgattcggtattaattgcgttaggtggtggtgtaattggcgatgtggctggctatgctgctgcgtcttatcaacgtggtatccgttttattcaaattccaaccaccttattagctcaagtggactcttccgttgggggaaaaacggcggtaaaccacccgcttggcaaaaatatgattggagcgttttatcagccgatttcagtcattgttgatacaaataccttaaaaaccttgcctaaacgtgaagtgagtgcaggcttagcggaagtgatcaaatatggtgcaatttttgatactcaattttttgaatggcttgaacagcatattgacgatctcgttgcccttgaacagtctgcattagagtattgtattcaacgttgttgccaactgaaagccgatgtagtggctcgcgatgaaacagaaaaaggcgaccgtgctttgttaaatttaggtcacacctttgggcacgcgattgaagcatatcttggctacggtaactggttacacggggaagcggttgcagtcggtatgcttgaagcagctgccttgtcgcatattctaggcgatcttacagaacaagatgtggctcgtttagaaaaattgattgctcgtgcaaccttgccaaccatttcaccagatggaatgatgcctgaagaatatctgccttatatgtggcgagataaaaaagtactaagcggtcagttgcgtctgattttattaaaatcacttggcacagcttatgtcaccgctcaagcgaccgaaactcaagtgttagatgctatccgtcgatttactcaatcctaagttttaacaatgaaacagcgagcctttttaaaatgggcaggtgggaaatttcgcctgaccgatgaaattaatcggcacctaccccaaaaggcttgcctagtagagccttttgttggggctggctcagtttttcttaatacacattttgaacgctatattcttgctgacattaaccctgatctgattaatctctttaatgtgattaaagctgatgtggaaagctatatccatcaatcgcaagccttgtttaatgatccacaagcaaatacggcaaaattttattatgagcgacgtaaggaatttaatgcttgccaagatctgctacgtcgttcagcactgtttctttatctcaaccgttttggttttaatggtttatgtcgctataaccaaaaaaatgagttcaacgtgccatttggcgattataaaacccattatttccctgaaaaagagttacgcttttttgcggaaaaagctcagaaagcggtatttatctgtgccgattttcatcaagtctttcaatatctattagataatcctgatgattatgcggtctattgcgatccgccttatgccccgttgaagcaagaaacgaattttacccattatgctgggggcggtttttcccttgagcaacaaattgctttagcagacagagcaaaacaagctcaacaggcgaaaatccctgtcttaatttcaaatcacgataccgagtttactcggcaaatctaccgtggagcaaaaatcaaaaaactgaaagttcagcgtcacatcggtcaatccattgactctcgaattaaagtcgatgaactttttgctctgttctcttaacttccttttgtatgcagtaggaaaaaatatgaatacacaaccccaagaacgccaatcgtggtcaaatcgattggcatatattatgaccgtagcaggtgcaaccgttggttttggtgcaacgtggcgtttcccttatttagtcggtgaaaatggtggcggagcttatgtctcgctattttgtatcgcaatgatcgtgatcggtattccgatgatcttggttgaaaatgtgattggtcgccgtatgcgagtaaatgccattgatgcctttacgggaaaagcgaatggtaaagccattcaccctgcgtggaaaatcttgggttatatgggattattaggatcttttggtatccttgcttactatatggtgcttggtggttgggtattaaactatatcggcagtcttgtaacgggcggtttagatctatcatcacctgttaccgtagaaactacatctacttattttaaagagagtatttttaacagcccagttaccattttggcttatactggcttgtttgtattagtaaactacttcatcttagtcaaaggcattgttgatggcattgagcgttcagttaaatatcttatgccgatactctttatcttcttgattattatggtgatccgtaatgtcactttaccaggggcagcggaagggattaaattctatttaatgcctgatttctcaaaaattacaccgcaattgtttgtctttgtattagggcaagtcttctttgcacttagcttaggtttcggcgtattaattaccctttctagctacttagataaaaaagaaaatctagtgagaactgcgacaatcacaggggtactaaatacggtaattgcagtcatggcaggctttatgatcttcccatcactctttagctttggcattgccccaaattcaggcccaacactcgtcttccaaagcctaccgattgtcttctctaatatgtggggcggtacgatctttgctattattttctttggattattagtggtcgcagcattgacgacctcattaaccatctatgaagtgatcatcaccgctttacaagaaaaaactaaaatgagccgtaaagcagcgattttctggacacttaccctgattttcatttttggtaatgtaccatctgttttaggtgataatgtatggaaagatatcaccattataggcaaaagtatttttgatgcctttgactatatcagtggtaatattttatttattctcactgctctcggcagtgcgattttcgttggttttgtcttaaaagatgaagcgaaggaagagttaggggcagggaaaacattaacgaatttgtggtttaactatgttaaatatgtgataccgcttttgattttagtggtattttttagctcgctttaatttaaactgacttaacaagtgagcatttacataataaaattcacaactcaagcagtaatcaatagggttactaatctactccactatttttattttaagaggtcttactatgaaaattatcttattaggagcacctggtgcaggcaaaggtacacaagcccaatttatgatgaataaatttggtattccacaaatttcaacaggggatatgttccgagctgccattaaggaaggaacagagttaggtaaacaagccaaagcattaatggacgagggaaaattagttccagatgaattaaccgttgccttagttaaagaccgaatttctcaaccagattgtgcaaatggtttcctgctagacggttttcctcgcactattccacaagcagatgcactaaaagaagctggtgtaaaaatcgactttgtattagagtttgatgtggccgatgaagtaatcgttgatcgtatgagtggacgtcgagttcatcagccatctggtcgcacatatcatgttgtatataatccaccgaaagtagaaggtaaagatgatataactggcgaagacctaattattcgtcaggatgataaaccagaaactgtactagaacgtttagcgatttatcataaacagactaaaccattgatagcgtactatactacggaagctgaagcaggaaatactcaatactaccgtttagatggtactcaatctgtagaatctataagcgatgaactcaataaaattttagggtaatttcctttctacatatagaatcaaaaatagttgctaagaaccaatacgatcttagcaactatttatctcaacgttttattatttaatatgtctttcttgataccccgtataaatttgtcttggacggacaattttgaggctctcttcgcacatttctttccaatttgcaatccacccgactgttctgcctaaggcaaaaataacagtaaacatggaagttggaatgcctatggcttgtagaataatacctgagtagaaatcaacattaggataaagtttgcgttcaatgaaataaggatcgcttaaggcaatgcgttctagttccattgcaacttcaagtaatggtgttgttattcctaattctgcaaggacttcgtggcaggtttcccgcataacttttgcccttggatcgtagtttttatatactcggtgaccaaatcccattagacgaaatggatcatttttgtctttggctcttgcgataaattcaggaatacggtcaaccgtgccgatctcctgtagcattttgatacaggcttcgtttgctccgccatgagctggcccccacagtgatgcaatccctgccgcaatacaagcaaatgggtttggcccagaggaagcaacgcctcttactgttgatgttgaagcgttttgttcgtggtctgcgtgaagtgtgaagatgcgatccatagctcgttctagtacagggttaaccacataaggttcacaaggtgttgcaaacatcatgtgtaggaagttgcctgcgtaggataagtggtactgcggatacataaatgggcggccgatgttgtatttgtaacacatagctgcaagggttggcattttggctaagaggcgaatggcggttttttctcgatgtgcttcgtcatcactgtctagcatgtcattgtagaatgcggctaaagcactacttgctgcacacataaccgccattgggtgcgaatctcggcggaaaccttgaaacaagcgggtaaattgttcatttaccatgtaatgtgaacagatctcttttttgaactcagccaattcttcttctgtaggcagttctccatttagaagaagataggcgatatcaagataggttttatttaaagcaagctcgtcaatcggatagccacggtgcagtaagacaccttgttcgccgtcaatgtaggtgatactggattggcatagtgcagtagatgttagcccttgatcgtaggtaaagagttggtgcttttgcaatgcctcaacgccaattgcatcaaaacctaagttactctgataaacgggcaatggaattttacgcccatcattaaggtgaagttctgcagttaaagtcgggtgtagtttaggcattttgtcctccctgttatcgtaaattttatgcaaaatcaaaccgctgtttgaaaaatgaggttatctgctttttgggtataacgttgaatttggtcaaaattcatgtagcggtatgtatccgttttatctgcctctaggcgttgtacataatctaaatactctttccatgtgggaatgcgtcctagtaatgcacagactgccgcaagctctgcagaagcaagatagacaaaagagcctttacccatgcgatttgggaaattgcgtgtagaggttgaaacaacggttgagccgtcggctacacgagcttgatttcccatacaaagtgaacaacctggtatttcaattcttgctccacttttgccataaatgctgtaatagccctcttcactaagtagtgttgcatccattttagttggtggagcaatccataaacgtgttgggatcatgccttgatgctggttaagcaatttacctgcggcacggaaatgacctatgttcgtcatacaagagccaataaagacttcatcgacttgttggccttgcacttcggaaagtgttctagcatcatcagggtcatttggggcacaaagaataggctctttgatgtcatttaaatcaatttcaatgatagcggcatattcagcatcgctgtctgcttctaataattgtgggacagccagccactcttccatggctttaattctgcgttcaagggttcgtttgtcgccgtaaccctcagcaatcatgtattttagtaagatgatattagactgaagatattcgatgatcggttcttgatttaatttgatggtacaagccgcagcagaacgttcggctgaggcatctgaaagttcaaaagcctgttcaactttaaggtgctctaatccctcaatttctaaaatgcgacctgagaagatatttttcttacccgctttttctaccgtcaatagcccttgtttaatggcataatagggaattgcatgtacgagatctcgtaaggtaatgcctggttgcaattcgcctttaaaacggactaaaacagactctggcatatctaatggcattactcctgttgcagccgcaaaggcaactaagcctgaacctgcaggaaatgagatgccaatcggaaaacgtgtatgtgagtcgccacctgtacctacggtgtcgggcaatagcattcgattaagccaagagtgaataacaccatcacctggacgtagtgaaataccgcctcggttcataatgaaatcaggtaaggtatgatgtgtcacaacatctacaggtttagggtacgcggccgtgtggcaaaatgattgcatcactaaatcagctgagaaacctaaacaagcgagatctttaagctcatcacgggtcattggacctgtggtatcctgtgagccaacacttgtcattcgaggttcgcaatactgccctgggcgtatgccctccacgccacaagctcgcccaaccattttttgtgcaagtgtgtagccgactgttgttttagcatgtatttgaggtttaacaaacacttcactttctggcaatcctagtgccatgcgtgctttatgtgtcaaacctcgaccaataatcaatggaatacgtccgcctgcacgaacttcatcaagaagcacattcgttttaagactaaactgggctaatacttcgtcactgccatgcttacaaattttgcactcatagggatagaggtcgattacatcgcccatatttaattggcttacatccacttcaatgggtaatgagcctgcatcttccatcgtattgaaaaaaataggagcaatcttaccgcctaataccacacctccagctcttttattaggaatgtaaggaatgtcatttcccatgagccataagaccgaatttgtagccgatttacgtgaagaacctgttcctacaacatcgccaacataaacaagtggaaaacctttttgtttaagggcttcaatctgtttcattggaccaactacaccagcttggtcaggttcaataccctcccgttcatttttaagcatagccagtgcgtgcaatggaatatctgggcgtgaccaagcatcttgtgcaggcgaaagatcatctgtattggtttctcctgtcactttaaacacggtcagtgtgagtttttcggctaattttggacgagataaaaaccaatcagcattggcccaagaggttaatacttctttagcaaagcggtttccttgcttcgctttttctgccacatcatgaaaactgtcaaatactaagagcgtatgagagagtgctttgacggcaataggagcaaggcttggatcatcaagtgcttcaacaagcggttcaatgttgtaccccccttgcattgtgcctagcaagctgacggcttgttgtggggaaatgagcggcgaaactgcttgcccttttactaaggctgctaaaaagctggctttaacataggctgcttcatcaacccctgctggtattcgattttcaaagaggtgcaagagtaatgctttatctgcatcagcaggttctttaagtaattcaataagctctgctgtttgcgctgaatttaatggcagtggcacaataccttgtgcagctcgttcaaaaacatgtgtttggtattcagttaagaaagacataatgatgatccccacttcaatatagataaaaaatgagcgatgagataatcataacagagagagtaaaaacgacaagcaataaatttaacagattttacattttgttaacaagatcacaaaattgcatgattatctctatgtgtataagtggttacatattggcgacaatatcttgggcaaattccgaagttgtacggagtgttgccccctctaatgtttccgcaaaatcaaaggtcactgtcttatttgagatggttttggatactgcgtttaccactaaatctgccgcttcagtccaacctaaatgtcgtagcatcatttcgccactgagtatgatcgagcctggatttgctttgttttgacctgcgattttaggcgctgtaccatgcgttgcttcaaaaatagccgcctcttcccctatgtttgcaccaggtgcaataccaataccgccaacctgtgccgcaagtgcatcggatatgtagtcaccattaagattaagcgttgcaatcacatcgtaatcacttggatgtaataaaatttcttgtaaaaaagcatcagcaatgcaatctttgatgatgatctctcgtcctgtatttggattttttaaacgatgccaagagccattatctattggctctgaaccaaagtctttggcaacttggtatccccactctttaaatgccccctcggtaaatttcatgatgttgcctttatgcactaaagtgagtgatttacgatcattatcaatcgcgtactgtaatgcagccctcactaaacgctgagtcccttcttttgagacgggcttaataccaatgccacattcttccgtaaagcgaatttttttcacgcccatttcctgctgtaaaaaagcgattactttttcagcttcataggaacctgccgcccattctaccccagcataaatatcctctgaattttcacgaaagatcaccatatccactaattctggatatttcacaggacttggcgtaccgtggtagtaacggattggacgcaagcaattatagagatctaactcttgacgcattgctacgtttaaagaacgaatccccttgccgacaggggtcattaatggacctttgatcgcaatatgatactgtttaattgatgctaatgtttcttcgggtagccatgtgttttcaccgtaaagtcggttagctttttcccctgcataaatctctaaccagtcaatttttcgttgaccttgataggctttttctaccgcagcatcaattacaaaacgcatggctggtgtgacatcaacgccaattccgtctccctcaataaaaggaataattgggtaatttggaacagacaatgaaccatcatgatttagttgaatagcttgcccttttggtgtagtgagttcagatagcattatttcccccttaaatgcgacctaataccgcttaattgagtttgaaaataaaaacagcagatgttgtattttttacaagcaacgggataataccatcagataacaaatttaacaaaaaatttacatttaaaaattttcatcattatctgcaagttacataaattaaattcatgaaataatgaaaataattttattgacatcatatcgctggcattttaaagttttagccatctaaacgtctaaaaaagacggcagtatgcaaactaaacattatacaaataacaacaatagaagctctatagaggtgttgaatgagttatgcaaaagagattgatcttttaaatcaaagtgttgccgacttaaacggcaaaattaatgtgtcttttgaattttttccacctaaaaatgaaaagatggaaacgctgttatgggactctattcatcgtttgaaagtgcttaaaccgaagtttgtttctgtgacttatggtgcaaactctggggaacgtaatcgcacgcactctatcgtaaaaaccattcaacaagaaacagggattgtcgctgctccacatttaacaggtattgatgcaccccttgacgaacttcgtgctattgcaaaagattattgggacagtggcattcgtcacattgtggctttgcgtggcgatgagcctactggctatgcgaagaaacctttttatgcgtcggatttagtaaaactgttaaaagaggttgccgattttgagatttctgttgccgcttatcctgaggttcaccctgaagcaaaatcagcccaatctgatttgctctatttgaaacagaaaattgacgcaggtgcaagccgtgctattactcagtttttctttgatattgatagctatcttcgcttccgtgatcgttgtgcaacggtggggattgatgttgaaatcgtgcctggcattttacctgtgtcgaacttcaaacagctagaaaaaatggcaaaaatcactaatgtgaaaatccctagctggatggcaaaaatgtatcaaggtttggacgatgatcaaaccacccgtaaccttgtaggggcaagtattgcaatggatatggtgaaaatcctctctaaagagggagtaaaagatttccacttttataccttaaaccgttcagaattaagttatgctatttgtcatactttaggggtaagacctgaataagcgatttgcgatagcctaacccgatcttcacggatcgggtttgctctatttggcaacttatctttctatattcaaaaacgtaactttcttgtaaaatccaaccgcttatcacgacattttatagaggatttataatgacattaaaaattggcgttgtcggtgctggtggcagaatgggtcgtcagttgatccaagccgtaaataacacagagggcgtagaattaggttcagcatttgaacgtaaaggatcatcattagtcggggctgatgctggcgagttggctggtattgggcatttaggcgtgactgtcacggacgatttagcttcacagctcaatcattttgatctattaattgattttactcgccctgaagggacgttggaacacatcgctttttgtgtcgcacataataaaaaaatggtgatcggcacaactggttttgatgatgcgggcaaacaggcgattaaatctgcatcagaggaaatcagtatcgtctttgcttcaaattacagcgttggggtgaacttagtatttaaactgttagaaaaagcggcaaaagtgatgggcgattattgcgatattgaggtgattgaagctcaccaccgccataaagttgatgcgccatctggcacggcactttcaatgggtgagcatattgccaaaaccttaggtcgtgatttaaaaacgcacggcgtatttgcacgtgaagggatcacaggggaacgtaagcgtgatgaaatcggttttgcgacgatccgtgcaggtgatgtagtcggtgaacacagtgtttggtttgctgatgaaggcgaacgtattgaaattgcccataaagcttcaagccgaatgacttttgctaacggtgctgtgcgtgcagcaaaatggcttcaaaccaaacaaaacggtctatttgatatgaccgatgtgttggatttaaataatttataataaagaaaagcggtcaaatttaatcaaaattttgcaaaaggatagatatgaaatataacaacattgaaagtactttagtccaactgggtaatcgtactgatgagcgtactggtgcggtggcgaccccgattttcctttcgactgcctatggacatatggggatcggcgagtccacaggctttgactatactcgtaccaaaaacccaactcgtagtgtacttgagcaaggcattgcggacttagagggtggcgatgcaggttttgcattagcgtcaggtatggcggcaattcaattaattatgtcgctctttactgcccctgacgagtggattatctctagcgatgtttatggcggaacttaccgcttgttagattttagctacaaaaataacaataccgtgaagcctgtttatgtgaacacggcagatctagacgcgattgagaaagcgattaacccaaataccaaagcgatttttgttgaaacaccgtctaatccgttgatggaagagtgtgatgttgcagcgattgcgaaaattgctaaaaagcataatttactgctgattgtcgataatactttcttaacaccagtattattccgcccgattgaacttggggcagacattgttattcacagtgcaaccaaatatttggcaggacataatgatgtgttagcaggtttggtggtagcaaaagggcaagcgttatgtgaccgcttgttctatttgcaaaatggtgctggggcggtgctttcaccgtttgacgcttatatgattattcgtggcttaaaaacccttgcgttgcgtgttgagcatcaccaacaaaatgccactgaactcgctaaattcttagcggaacaaccgcaagtgcaagatgtgctttattctggtaaaagcggtatgttatctttccgcttgaaagatgaaaactgggttaatccattcttaaaagcgatcaagatgattacctttgcggaaagtttaggcggtacagaaagttttattacttaccctgcaacccaaacccatatggatattcctgaagcagaacgtatcgctcgtggtgtatgtaataagctcttgcgtttttcggtggggcttgaacacgttgaggatattaaagcagacttgctacaagcatttgctcagttgaagtaaattggtgtaatagacaaatttgttgctaaaaagtggcttaaagccttatagtacaaggctttaagccactttttttgaaatataaacaaaaactacccattttgccaaagtccgaaaataaagaaacatggtatacaaaataatactcaaccttacttttgtaatgaatgtcataaaacgtttatcttaaaaaatgaattttattagcgattacgtccttagtttataaaacaccaaacgtttttaaaagaatgaagtgataaagccaataaaaaagaccatttcccttataaacgtcgtaatgcaagaagtgcttataccagcttaaagcgttatatggattttatttttacctatgagaaatattctaaattaaatatagaaaatacaataaatcgcttagagggattatttagcgagcttaagcaaaaattaaataatcataactgattaacaaaaaggcgtaatattttgtttatacaagattttttaaataaaaagagttgctaagaataattaaaaatacccattagcaagtattttatttattatacctatcaattagacaatctgtttttttgcaatgcgcgatgttttacttgatgtacgatatttgtaatcaccccagcgatatttacatcactccattctttaatgcgtaaattaggttctgaggtgtctaaagaaaataaaatcttctctccattaatctcactgaaaaattggtagaacttatactcttgatttttctctaataccaaaagatcgttaatttcagcagattgattattctctacaattaacaaatcatctaattcgatcccccatgcaattaaattagggtttttcacatgaaccagaaaggtttcagaaggacgacgaacataaagagaatagagatccagtttgattgggtgctttatattagaatctcgataaaggggtaaaggctgatgggattgtgccaatgttagtgatctaagatacgccataaaaatcctctaaaataaatctgtgtgtttatacagttattttactgtttaaacacacagtgtcaataggaattttgcgttttagtgtaaatttttacaggtaaatcatcaatcaatattttttagctgttcttcagataatgtttcttgctcactattttctgttttaccatcttttactttaaactctaaattttgaaaataggcttctcggaaagtaatgtaaggatcttgagattgcttcaataacgcttcttgtcctataagctgtgcacgggaatctactccttgtacgacatattttgtgatactccaaggtgtagcgagtaaagataaaactggataactagtatctactaatcgacctaaatcttgacgaggcgttgcgggtccatacattggtaacatcacataaggtcctgtaggcacattatacgcgcctagagtatccccaaattctctacgtttatcaattttaagatcattggtcatactcgcgaagtcaattaacccgcctaatccaaagatagagttaaaccaaaagcgagtaaagtggaccatcgctttttgtccttccccttcaattaatcggtttacaaagctggcaggttcatcaaggttatttgccacattgactaaacctgttttaattgggctaggtacataatctcgccaaccttttgccacaggttcaagaatataagggtctagatattcgtaattgactttccacatggcacggttaaatccttccaacggatctgaacgggtgccagtttcaggatcaatagaagcagtacaagcggttagaaaagcggtattgagaactaaaaatagaagtttaatttttttcatatgactactttaaaaaagggttgtgttgtttttcacgtcctactgtggtatgagatccgtgtccaggaataatgataaaatcatcttctaaatcaaatagttgtgtttttattgtataaatgagctgctcaaaattaccttggtataaatcggttcttccaatactatctttgaaaagcacatcgccactaaaggcaattttattctcaaaatcaaaaaagccgatatgacctggtgaatggcctggtaaatagcgaatatggaatgttaaagccccaatttgaattttatcacctgcatttaaccagtgatctggtagaaaagcgggcgatgcaggaagcccgtagctctgacaaatattaggaagttgttcaaaaagaggttgatcgttttgatgagaaccaaagacatcaacattaaaatgttttctcagtcgatcgacagccataatatgatcaagatgaccgtgagtaatcaacaatttctgcacatttaattgctgttcttccacaaaccgaattattttgtctgcatcatcaccagcgtcaataataaccgcattcttttcgttatcccaaacgacagaacaattttgttggaaaacacttacagggataatttgcaaattaaacataaaatcaaaccgcttatgaaccacgccaagtacgaacagggccagtgtcgacgtggacaaaattactgtgaggataataaccaactcccccgttattcaggctttctgctgccgcttttatgcgggcaagaggaacaccttcaatacggaaatcaatggctttacctaaaatatggtagctattgctagcaacgcctcgactacgacggcgtaatctagcatttgtttgagcagaacgatatccgcttacaataagaatttcagatttacgaagacccaagcgagcttgaatttgagttaattttacgaatagttttgggtcaattcgcttaattctgttgatatgcacatcgcgcataatatgatttaatctgttaagatcctttgtaacaaatccgttagtgtgataattagccgataaggtctcgcctgtacttaagcgttttaaacgtagaataagaggttttggagttgacgttaccgcatgaactaaattaggtaacaaggttgcacccaaaactattccgcctaatgcaagccatcttcggcgttgtaaatttgtttgttccattttatcctcgcatttgggttatttaccgacaatctctcctttaatctcttaaaggtaaatatattcagcctgacttcgacattttatcaaaaagaaagttctaaaaaatagcttatctctttcggaaattttttattttgtggactagatcacactttttactttttcccaatctaagttgattttaggtaatgatttatcaaattgataaatatcaggtaaggtgtatattttaccgccttcaacccaggatgttacataatataaataaacaggattatctgaacgaataggtgcagatattgtttttttacttgcaagaacctcctgttttctctgtgatgaccacccagcttctgccaataataacgtagctagttcatctgctttagctacacgaacacagccagagcttaacgcacgattttttttactaaataaccctctatttggtgtatcgtgcaaatagattgcatcggaacttggcatattaaatttataacgccctaaagcactatcatctcccgctttttgacggatatgatacgggaaattattttttccttcataagctgcccagttgatactatgagcactaaatttattccctttcccatctaaaatttcatagcctaatttatcagcaaggcttggatctttacgaagttttggtactaaatctttattcttaattgttgatggaacattccaaggcggattgacgacaacgttgctcagtttgctgtacatgacaggtgttttgcgatcatttcttcccacgattactttagactgtaaaacaagtttgccctctctgaaataatagagctgatagcttgggatgttgacaaaaattccattattaaaacttggaataagacgtaaacgctgcgcattaagtgctaattgagtaaatgaaggcgtgtttacactacctttattctcttttgtagattttgctgatttattaccaccctgattgagagcatcattagatgatatttcaaataatttttgtacggtttcttggtaaatatggtttttaggtattagatccgtgacaaactgagcgtggcgatcttgtttcatcgcttccaaccaagtagcaatacgatattctgttggtgttttagttgaatagcttcctaaatgatataaccactgatttgaaaattgatcaacattttctatgtaatagagataatctaagaaactatctgtgagtagaatatcgcgagcaaatccctcattcatatttagaatttgttgtaacgcattagctgatttaggcgaaacgccgcttacagcaaatactgcatattcttttaaaaactgtttttctgccactttatctttccacaaaggggcaaactcattattgagatatacttttgctgtcgtattggataatagtaaatgatagcctaatgtttcttgttgaatacgttgttcggcatgaattaatttttcggcttcaatgcgttttctttcagccaattgaaattgatattctgcatcttgtgtcagttcagcaatacggactaattgcgctttaaaacttaactgaggcaaaatttgttcatcaggaacaggcattgcagcattatgttgagaactaacattcaacgcacttccattttcagcaaccacagcactagaaaacaatattactgacaaaaaagttaaacttttcattcaatttaatccattaggaaaatgagtaataaatcagaccgcttaaacagcggcctgataaacttccacattataaacgtatttattattttttatcaaattgtaaccaatcaaccatcatctgctccgtttcttttaagaagaaatctggggcttcatagtcttttggtaactgttcaagatctttgatctgttttttaccttcacgtttaaagcgagcatttaaatctttcaaacgacgagcttcatcagctttactctcttcttgacgagaagctaaattaagtgaggtaaatttacgatcatctctttccttattaattgcgatagtttcatttaaagcaataaattcaggatttttagcaatacgtttttcgtgattttcagtgagttgtgcaactacatctctagcttttgcgacttctgaataagttgctgcaggaattttatcccaaggcaaagcattatcttcaaatccttcccctgttttttctgcattgataatttcagggaaacgaatatctgcttcaacccctttaatttgggtgctgccaccattaattcgatagaatttttggattgtatattggataaaacctaacggctcttgatccaaatcataaaccatatttaaagaacggttttgttgaacagtacctttaccaaaactttgctgcccgataataatcgcacgattgtaatcttgcattgcagccgcaaaaatttcagaagccgaagcactatgacggttaatcatcactaaaatgttgccatcatataatgttgtactatcggtatcttcgtgaacacgaatacgattaaaagcatctctaacctgaacaacaggaccatctttaataaataatcccgttaattccactacctcaggcaaagaaccgccaccattttcacgcaggtcaataatcaacccatctgcttttttggttttcatctgttcgagaagtttacgcacatctgcagtcaaaccaatatagaaacttggaattttgatcacagcaatattttttccgtctactttatcaacagttaatttcgccgcactgtcttcaagacgaattttatcccgaactaaactaataatcttggttttgccgcctttagcaggttcaatttcaagataaaccgtcgaaccttttttacctttgatattatcgacaacatcatctaaacgccagccaatcacatcttcgattttatcttttgattgccccacaccaacaattttgtcacctgctgcaatttttttactacgcgctgctggcgcaccaggcaccaaagatttgatgatcgtaatatcatcttccattgaaagcgtcgcaccaatgccttctaaagacaagttcatactctcttggaaacgtttagctgcacgaggtgaaagataacttgtatgcggatcaatttctcttgcaaaagcgttgagataagtttgcagaatatcatcggctttattttgtgttaaacgacgaattgccaagttataacgtttagtcagtgttttcttgatttcaggccatttcttatctttcaaataaagattaataatatcgttttttactcgttgcaaccaaagctcatcagcttctgtggtagttttcgggaacggtgctttttcacgatcattttcaatttgatcctgcccttttaaatcaggctctttatctaacaaagacaaagcatatttataacgttcataacgacgttttgtcattaactcatacatttcaaaggcaatatctagtttgccttcatagagttcttcatctaacttggttgcatacttagcacgcaattcatcaatatcagactgtaaaaaggtattgtgagaaccatcaagccaatcaatataacgattaaaaattttctcagaaaaagcatcatctagttgaaacttatgataatgcgattgtgttaagcgagccgtaacacgtttagttgaagtaatatgttgatttgatggttctgggataaccagctcactctcttttatttgtggctcgacggcaaaagcattaatgcccatcacccccaagcacattcctacaaatgtagtgaatttagtatatttcatatctatcctattaatagcaatggttattttttgcctttggcaaatttgctttctaatgcgactaaactctctaaagatgcttttggcatttcttgttttttcgtttcagcccgttttttggcatgcgcttcacgtgctttttgtttaaagaaagttttacgctcttccttgcgtttctcttttaattgctgagctttacgttctgcataagctgctttagcttcggctaaagattgtgctgcatgttctgcttgtgcagcttcaacaactcccgcttcttctccttgaagaccgacacgtacagcaccttctttacatgcgtgtaagtaacgccagttcattgtataaacacgtaatgcttgacgaagccccgttttactgattttttcatcatcactcaacgcttcaactaaatcttggaaaagtccaatttttagaggtttagcttcgccttctaaattaaagcaaaacggaaatttttcagccaaataagcaatgatttcttttgtagataaagcggtttttaggttttgaatggtattaagttgttgttcagacataaaatgttccaatctaaaaaatgaatgttaggtaagcgaataaaaatgctgcctactatattttatttagttacagtagtccatagactttccaataagttccttattctttagtaaaaattttattttttaaaataatatttgccttatacagtgataaatgttgtaatgctgcccgttgaaattttcaaccatttttaggggctgacgtagattagccctaaatttcacaccattttctcaacgttttaagttgctcttttggtgttccaaagttaaaccgaaattcacattctttcaagaataaagggaaactttttcggtcaatcccattatattttcggagtatccgcttggcttgattccaaaaattttcaatgtcgttgatgtgattttgtttcactgcaaacaattccgaatggttaatgcgttcgtggtgaaattcgcttacatcaagggcatcataactacgataagtatcggtataaacccagctatcaggcttgattttccttgctataacaggcattagcgttgttgtcttcgtatcattgacgaccacagtaaatacttttccttgccgtttcaatatcccaaaaacagccacttttcctgctgctccacgacctcgttttcctttacgaggtccaccaaaatagctttcatccaactcaatttgtccgtcaaatacttcatctgcttcaagggctaaatgattactgatgacctcacggatttttcggtaaaacaggatcgctgaattgggctgaatacctagcaaatctgcgactgatcgagctgttacttctaacacaaaaaattcaaggagtttcttctgtatagatttctttaatttacaatgagttatcttcatttttgtaggttagcatactagctaatctacgtcagcccctaaatctttcatcaaaccacatctaccatcacaggtaatcgattgaatgatatagcctttttctcttaacctattcagggcaagtttgtagtaaatatctttttcggttcgcacaaagtaatgggaaatcacattatttgaattagaatccattagcactaatacgccaaaataacgacagaaaaacgttgtatccataatgatgtttaggtatcgatttgaaggtggttttaaagctgttttaggggctttatcaatatatctttgaatagttctaaccgaacaatgatatttttcggcaagttgttgataggtttgttttctggatgtgtaatcagtccaaattttaattggatctaatttagattttaagataaacgttttataacattcattacaaaaataacgttgagtattattttgtatacaatgtttctttattttcagactttggcaaaatgggcagttttttgttcatatttcaaaaagaaggcttaaagccttgtactataaggctttaagccaccttttaccaacacttttgtccactatgtcgttaatccctagtataagataggaatttttttcctactccgccaacccctgatcccactctaatgcttcttcaggtaatttacgttgtaataaaaatctgcgattagcttctgcctgaggttgaacaaccttacttgatggagttgagaagctaattccaccgttaaataattgggacattgtgcctgagttcaggctgacaccattgaggctgatatccattgtgtagcctgaggaagcccagaactcgctatttttacggacaaggtgtttatattgattggctatgcgtaaatggatcagtactcgatcaccgagttcgcttaaactgagttgttgtaccatacccacttgcattcctcgatacattacaggggcttgtagggtgatgccatttgcgtcgctggtttccacaatgattgggaagccgttaccatattgtgtatctgcggtgtctgttgcccctaatttgaactgcgtttttcgtttgccattgcctgcttctacgctgatgtagttttgaatagcagcatcaagatttttgaagcctgttgtgtcaatttcaggggaaacagcattaaatttgctacctgctttggcgacaatggcataatattgtccttcgatgtaagcggtggctttcacctgttttcttgcattgtctagctgtagcgtttcaacattgccgatagttaatcccatatacttaatcggcattcctttgcttaatttagaggcatcttgagcaatcaaggtaatataagtattaccagaaatcgctttcgtgtaactgctatacaaggtcttgctatctttagttccctgattatcaaagctaatcgcccctttgagtgttcgcattagtgaacccattttgagattaacaccgttggtcgatacgtttacctctaccgctggttcaacccagaaacgactagtttccgtcagtagatggcgatatttaggttcaataaatagatcaacttcaaacttcgttttttgtgggcgaatgttaagcacctcacctatcgggaagttgcgataaagcacttgtgagcctttatcaatactggataattctgtagcagataaactcagcgttgcttttttctcactacctacaataccagcttctgcactctcaatatctttgaataatgggtattgttttttcgcttccccttgagctttatctgagaggatacgaacaccgccagcaagccattctgatggagaagcggattgcactcttagaccatctaagccaacggctacatctaaatgcgagatcgccacaaatttactgttccccgcgacaagggtacgataaggcggatagatgatgccttgaaattctacgccgttaagcgataactggcgtttcacaatttcgccaatttgtatatcgttataataaatgccctgcccttcgcttacaccataagattgtggcgatgaaagggtaattgccagcacattagggcgagtgagtaaataatcagtttctttttgtacattaaaggttaattgaggttcgccttctcccttttcgatttcaaaataagcacctctcaatagctcacccactttactcaattgttctttattgagtgcaaatttaggttctttcagtaaaatttgactgccagaacgtaatagatccgtgtgtgcagggtcgatcaataatttaccttgaatagtcgctttggttggtttgcttttgaagtaatcttgttcaatttcattcagctcaaggtgtgaaagtacgccaacttgcaggttttggtaataaacaggcgtttcatttacttttaaattcgacatcattggcaaggtgatgtttacttctgttcctcgttgagccaattttaagttatcgaaaagttgaaaacgttcgccctgttcggcattggttgccatatcaggcgagtcaaaagcaactgccccttgcaccatagaagcaagactatccacattgagattgaccccagtgagatttgcattaaattgaataccgctgatattccaaaagcgactttcttttttgacaagattggcgtactttttatcaataactacgtctatttcgacatttttttgatcttgggtaaagcggtaatcagcaatgcttcctactggcacttttcgataataaacgcttgcccccacagtcattgagcctaaatctgaagcaactaatttcaccaataaatcaccatcagcaacggtcactgcaggtggttcattttcagccacaaattcatcttgactagaggcatcttcatcatcatttggcaataaagtgatgtagttacctgaaacaagcgcatctaaccctgacactccggctaaagaggcactcggtttgactagccagaactttgtcccttcttttaataccgatttcgcttcgggattaacttctgcttctacctcaatctcttttaactcattgatgaaatagactttttttacttgaccaatttgcaagccttgataacgaatagcagtttttcctgcggtaatcccatcgcccttactaaaacgaatggtaattttctgtccctgctcttgaagaatttggaaaaaaagcaaacagccgatcacaaaagcaacaattggcaataaccaaaatggcgaaattttgcgaggttgccgtactttagctggaacagtattgggaatattttcagacatcgttttaccacttttaaatacacgcaagcggcgagattttgcaaaaggtttgcgaaatctcaccgcttgttcttattaacttattgaaaaagaagaattattttttatctttttcatcacatttttgaatattgctacatttaccatacaaatataagctatggtttgcaagctcaattccgtgttgttggctgatttcacgctgacggcgttcaatttcagagtctttaaattcaaacactttaccacaatccatacagataatatggtcatgttggtggttcatatttaattcatagacagctttattcgaatcaaaattatggcgagttaaaatgccaacttcttcaaattgatttaatacgcgataaactgttgctaacccgatttcagactgacgttctagcaataatttataaatgtcctcagcagaaaaatgctgcatactatcacgggtgatttgcattaactcaaggattgttaaacgtggttcagtaacttttaaacccacttttttcaacagtttcacattttcttcagacatatatcctccaatagatatattaagctaattccgctaaatacatttcatcaaaaatttgtttacaccaacggtttacacgttcttcggtgagttctggctggcgatcttcatcaatacataagccaacaaaggtttcatcatcaactaatgcttgtgaagcctcaaaagtataaccttccgttgaccaatgaccgacaatagtcccaccgttaggttcaataacatcacgcacagttcccattgcatcgcagaaatattctgcatagtcttcttggtcaccacaaccaaagatacccacgatttttcctgtaaaatcaatttcttttaacgtcggcataaaatcgtcccaatctgcttgagattcaccgtaataccacgttggaataccaattaataagaaatcgtaggcttcaatatcttccttcgtactttttgcaatatcacgaatatccactaggtttgcacctagttgtttttgaatcattttagaaatattttctgtgtttccagtatcactaccgtaaaataaaccgacaactgccatttgaaatacctatttacttaattcaatggaatccccattgagataatcgtttaaaatgagttcaattaactgccctctagacagtccttttaccgctgcttcttgttccaatgccaccactaaatccgaatgcaatttaagctcaacccgtcttaatcctgacgaacgatctcgcctgagttgattacgtttattaattctaacttgttgctctcggcttagaggatttgtgcgaggtcgcccaacctttggcatattttcaaacagatcaagcgtaatacaatccgaatcttgctttgccattactacaatttttgggctgagtgcttcttactcagatgagaatgagaagctaattattaaagtgcgaactatagcacaatatagaattattggaaacgccctatcaaaatattcattataaattgagattacctaaaacataattagctattattctgctgccatataactaaataaaaaatgtaaactaattttatttagtcattacttaacctatgtcggtaataagccacaaccataatcaccaatcccccgataatcattggcaatgaaagcaactgccctcgtgtaattaaatctgctgccgtattaacattcggatcgaactctcggaagtattcaacgataaaacggaaaaccccatagccaactaagaacaatccagctacagatcccactggacgaggtttacggatatagccattgaggataaagaacagcaccaaaccttctaaaactgcttcataaagctgagaagggtgacgaggcaaataaccgccactaggaaacattatcgcccaaggcacatcggtcacacgtccccaaagttcatcattaataaagttaccaatacgtcctaatcctaaaccaaaaggaataagcggtgcgataaagtcagcggtttgccaaaagttgcgattttgacggcgagaggtccaaagcattgcgacaatcacaccaagtaaaccgccgtggaacgacattcccccttcccaaatacgaaataaatagagaggatcttgtaggaaacggtcaaagctataaaagaacacatcaccaattcttccccctagaacaacgccccagaagccattaaacaggagttgatcgacctgttcgacactccatactctattagaatttttcgcacgtttggtaccaagccaataggcaaaaccaaaaccaagcaggtacataatgccgtaccagtgcaaagaaactggacctagctgtaacgcaactggatcgatattaggaaaagttaaaaactgttcagacataaatttcctttattttaaaaacatattcacggcaatacacatcaagaaaacggcaaaagcacgttttaaaatcggcactggcaatttgttcgctgccgttgcccctaattttgaggtaaaaatagaggtcagcgtaatccccaccaacgcaggtaaatacacataaccgaccgcatattgtggcaaattaggattatcccaaccactaatcacaaagctaatggccccagctaatcctaacaaaccaccacaaaaagaagaagtaccaatcgcttttttcagctcaatccctctgctatttaaaaatggcacaataaaagcaccgcctgcaatgccagcaaaactggataatatcccgattatccccccagcaatcacagtagattgagtagtcaaagacttaggctctgcctgctttggtttgagagataaaaacatcttcagcgaaagatacaggatcattacagcaaagatttttgtcatcacatttttcggcaaatcactcacaatcaagcctgaaataaacaccgccaccatcaacgcaggcacaaaaaacttcacaactgaccattgcacattgcctaacttatgatgacgttgtgccgctgaaaaagtggttagcacaatcgttgaaaaagatgtacccaatgcaatcgacatcaacaaatcatctggcacaccaatttgaggcaacaaatacacaagggttggaacaataatcataccgccaccgataccaaacaaccctgctaaaaaaccagcaactgagcctaaaatcaagcaacagacaaacatttccaccattattttttctccttaaacgcccgatatggtttacgaagctcacgttttggttgagtacgaaactcttttctttcgtggctaaattctttggtatctcgatttttctcgctttcgacttttttctgcttatccatcaacacctgagcaaactctttcatcaccttgcggtacacatcacgtttaaacgacactacctgtcgcacaggataccaaaagctcacccaccgccagccatcaaactctggcgttttactggttttaagattaattaccccttcatctgccactaattgcaacagaaaccaacgctgtttttgaccaatacatacaggttgagtttgctcattacgaactaaccgttttggtaatttatatctcagccaatacttcgatgcccaaagtaatcgcacatcctttttcgttaagccgacttcttcataaagctcacggtacattgcttgctcaatgttttccccctcattaatccccccttgaggaaattgccaagagttttgaccaaaccgcttcgcccacagaacctgcccttgcttattacagataacgataccaacattcgggcggtaaccatcgaaatcgatcaatttagaccgccttatttaatcaatttgaaaatggtgtgattgtttcatacttcggctatttgaacaactagcaaggcgaaaacaagcggtaagataaccaaattttttcacaacggtggataactctgtggataacttggaaatttgttgataacttttttgggataaacgatctaaccgcttgatctctctttagatcttatttcctgttctcgatcatttttgatcccttttcactgtataagcacacatttgatcgctcattttgtttgctttctagaataacttagccatttttcagactaaattgccattctattcacatttgatatgcttttatccccattccctgtggataaaattgtgatagatcgggataatgatcgtgtataacctaaaatcagcccagatattttgatttttccctttaaaaaacaatatgttattttattcttcttatcagaaaaaaacaagtgctcatttattaaacataatataaacattaacaactatcaaaatagtgaatttgtgggaaaatcatgtttaatgttagaatccagcccgtttttctaattgttctacaaaattttcgtttaaatttagcttctcggctaagtgggataaaaatacgatctcttttctagagagctcttgacagaccaagcgtgcagcgaggtaaacttgtgccgctaaagcggtgtcgtttccgacagtttttgcaatttcattaacggatactggctcgtgcatttcatgcagtaaccattgttgtaattcagggtcattaccgccctcttttaagattaaagcttcttcgttctcatccagctcaccgtctgctaatgcagctgcaagcattgtacgtaaaataattgctcccttctcttcagagctgtccgcttcaaaagccgcttggctcagctctgtggtttgaattgtcgcttggttcttttggtaatcttgataggctttgtaagccagtccgccaagtgcggctaaagatccgagtttagtcaaattagccccgccgtttctgcctaacaccatcgatagaataccgaccaatgcggcaccgccgccaactttggtaatagtatctacgttgcccgatttgatctcaccggcagtatttttggcagaacccaatacagagcttaatacgttacctaagtccgatttactttgattagcggtgttgccgacagattttaaaacgccgtttaaaatgctattaaaattcatattgctttccttttggttaatttggttaataaaaaataataaagagtagacattatgttatcaaaataattcaatttttttctgcaataaatttctttgccaacgccgacagtgcatcggtcacataaactaacagcaaataacagagcagataaagggtaatttcagagtaatggaaaaaactcatcgccagcttgaactgcatacctaagccacttgccccgacaaaaccgacaatcaatgtcgcccgaataatgttttccatacgataaagaatgtaattgagaaaagcacgcatcaccgcaggataaatcccgtaaaacagaatttggttttgcgaagctccgttttgcattaaatggtgtatcggtttttcatccatatcttcaaccacttcgctgcacagtttgcctaatacaccgaaattgtgaatggctaatgctaatgcacctggaatgatccctggtttgaagataaagactaaaatcatcgcccacattaattcgggtacggatcgactaaacagaaataacccccgactgagataataggcggcacggtgataccagtatgttctgtggcgaaagtgtccttgtgccacgttgcgagcggacggcagaaccaaaaggaacattgtcatgcctgcaatccctgttgccagaatactcatcacaaaggtttcccacgagagccatagggctttttgccacatttcagggtcaagataggctggaagatcttcacctatgccagccattccagctaaaaattccgtgagataatcccaattttccgctcgaaacagttcactcagtgcagtgggttgatctttaagaatatagccccacgacagcccgataagtcctaacacagcccaaaatgaatagcggataaaatagcggtcgatatgttttctcattttactcggctcctgatggcatagctccagcggtcaaccagaacgattaacccgataaggaagatcaagaatgtccaaacctgatcatatttcagatcttgtaaagaaagctgaatttgcataccgatcccccctaaaccgacaaaagaaagtaccgacgaagaacgaatagcacattcaaggcgatacatggtatagctcaacatcgtcggcaaggcttggggtagatagccataaatcaaacattgcatcggcgttgcccctgcttcttttaacgcaaaaataggtttggaaggcaccgcttgtaacgtatctgcatagattttgcctaagtagccagaataaggaatagcaagggcaaacactgcacctatcggatttaacccgacagccgcaacaaagaaccatgcccaaatcaattcgtgaatagcacgtagaaagcccaatatcgcacgggcagccccctgcaaaatgagtgaacgaaacagcacaccagaagcaaaaatgcttaagcaaaatccaccaaacatagacaaagagagtgtaatcaaggcataagcaaaagtgagccaagtggattgcaaggcgagtttcagtaaatcagcagaaaagtcaggggacaataagctggaaaatagtcgagtaagcgttgcccaaccaccagaatgcatcaaccctttgtcgttatcgacggcaaataggctcaacaaaaatgcaagcaacaacatacccgtaagcaaatttcgccgttcatttagtccaagcggtcggttatgtttcattttttaccaatccgtataagacattaagttgctcttgagtgacttgctctgtttgcaaatcaaacacaatttttccctgtttaatgccgatcatacgatcaaaataggctttggcatattccaccgaatgcatactggcaatcaatgttttcccctgctctctcaccagccctgtcaataatgccaagacattttgtgcattaacaggatcgagtgcggacactggttcatcagctaaaatcaatttagggttttgtactaacagacgagctattgcaacacgctgctgctcaccacctgacagctcggcagttggctgatcgattttatccagtagcccaacggcagcaagtgcttgctcggcaagatgtctttcttgcggtttaaccaaagagaataaggattgccaaaatccccactggttcagcctgccagccaagacattgtggataacttccagttgtttgactaaatcatactgttgatgaagcataccgacttgttgagcaaactgtttgttatctgggtaatcttgaatattgcaattttccagccaaatctcaccgcttgttaaaggcacggaacgcataatgctattcattaatgtcgatttccccgaaccgctcggcccaactaatgccacgatttcacctgaatgaatggttaaacagatgtcgtctaaaacggcttgcttgccgaaatgtttggtggtgtggtggaatgataagagagattgcatacaggaattattgtctatgttgcttacaggtcaatattgtagggtggggcttgacccaccacatgaatgtgattttaaatggtgggtcaagacccaccctacaaaataacattatttaatcaacttcagctctttcgccactttctcaatatcttgatagttgctgttttgcgttgggataaacttctcggcagagagtaaattcatcacctgcgagcttgacgcatcggcttttaataatgcagctttgactttctctttggtaccgtcaccaaattttttatcaacaagattaatggtccagttgtaatcatagtaatctggtgtggtgtaaaaaagctcgactttatcgtgattaaccttgccttcttttgccattttatcccagtactgcttatttactgcaccgatttgcactgaacctgcttctactaagccgtaggttttatcgtgcgaaccgctgtaagtcggttgagcgtctaagtctttttctgggttaattccagcttccgttaagaaaaagcgaggcattaaatgacctgatgtcgaactttcgctaccaaaagcaagggtgtgacctttaacatctttaatctctttcacattatctaagcctttttgcttgataaagacggacttaaatttctcatcttgcggacgttgtgcgatagcttcagcaccttgcactttggcacgagcttgtacccccgttaaaccaccgaaccagactaaatcaatttcaccacgacggaatgcggtgactacggcagcataatcggtgacaggtacgtattgcacctttaaccctgtttctttgcctaaatactcagcaaaactgtcgaatgaacgggtcatttcggcagcgttatagtcaggaatagcactgattttaaaggttttatcggaaggtgatgcgatagcaactgagctaaacagcacgctgagagcggtgaaagcagttgcaaaacttgcaaaaagcggtttcatggtgttctccaaaagaaatgtaaataaattgtaatgttcaaaatgaacgtgcaaaagatacgctattttttataaaaaacaagagatttctgcaacagatagaaattatagaaaaagttggcaaatggcgacagtttctctataatccgcagagttatactttgtataattttaaaggaacctatatgcaagtggctgtcaaaaaatggggaaatagcgtaggcattcgcattcctgctttattatctaattcattgaaattacaggcagagagtttagtcgatattcaagaagttgatggtcgcctaattattgagccgattaaacctaaatataatttagagcaacttctttcaggtattactgaagataatttgcacaatgaagtcgattttggcaagcctgttggcaaggaaatgctatgactactcaagagtatatccctgacgttggtgatattatttggcttgattttgatccgcaagcaggacatgaacaagctggccatcgtccagcattagtgttaacgcccacgatttataatcgtcaaacagggttgttaatttgctgcccgctcacaacaaaagtaaaaggctatcctttcgaagtcaatattgcaggtaccccccaaaatgttgtgctttccgatcaaattaaaagccttgactggcgtattcgtcacgctaaatttaaaggtaaaattaaccatcatcagttaagcgaagtaaaagctaaaattgcgactttgctacaaatcagtgaataatttctatggcattaatcgaatacaatccccctgttgaaccttggcttgacgaagtttatcgtgataatcatattttagtgattaataaaccaagtggcttactttctgttcctggaaatcgccctgaatatcaagacagtgcgatggtgcgtgtacaacagaaatatggttttactgagcctgctcaccgtttagatatggcgacaagcggtattttgttgtttgcattaagcaaacaggcggaaaaagaactcaaacgtcaatttcgtgaacgtgagccgaaaaagcactatcaagcgttagtttggggcaaattaggcgaaaaagttggcgatacggggacaatgaattttccgttaatttgcgactgggaaaatcgtccacgccaaaaaatttgctacgaacggggcaaacaagcggttactttctatgaaatttttgcacattatcccaataacaccacaagggtgacattaaccccttatactgggcgttcacaccaattacgcgtacactgtttagccttaggtcatccaattgtaggggataaattttatgcaaatccgttggcaaaaagtctatcgccaaggctctgtttacacgcagaagcattaaccattacgcacccagttacgcaagaactgatgacatttgaagcgaaacctgaattttaaaaggtagatagaatgaactttcaatggcagaaatatcctgaaaatacgcaaaaattattcaaactttcgatcccgattttcatctctcaattagctgcttcgggaatgggactggcggatattattatggctgggttagtcagcgatgatgatgtgtcggcgatagcggtcagtaattcgatctactttcccttgtttttatttgtgttggggatattaaatgcgattactccaacggtttcttatctaaacggttcgagccaacgttccttgattgcacatcaaatccgtcaaggcgtttggattgtgttgatgctcagcctgccgttaatttttatctatctcaatgcccatttgattttagatctaatggataccccaaaagccttttcaggaaaagcacaagattatcttaccgctttaagtgtcgggattattccagctttgcttgcggtgaacttacgctgttttaacgacggactatccaaccctaaaccagcgatgtatatcaccttttttggcttaattttaaacattccgctcaactatatttttattttcggcaaactgggtatgcctgaattaggggcggtcggttgtggtgtggcaacggcaatcgtaaactgggtaatgtttgggctgattttacactattgttataccaacccagcacaaaaggatattcgtctatttgaaaaatggatcgaaaaaccctgtaaagcaaccttaagcaaactgttcaaacttggtacaccgatagggtttgcactgtttaccgaagtgatgctgtttgcggcatcttccttgattatctcaccgcttggctcacaagtggtggcaagccatcaggttgccttacaaaccagctcgctcttttttatgatcccactctcatttagcattgccacaaccattttagttgggcaaacgttgggagaaaagcgtgttgcagaaacaaaatatctgacttatcacgccatttttacgggtgcaatggtcgcaatgggactggcaatggtgattttactgctcaaagatctgatcccctatgcctttaccagcgatccgacttctattgcaatcgcatctagtttattgatttttgcagcgatctatcaaatccccgactctatccaagcggtatgcaatggcattttgcgtggttataaaaataccaaacctattttgctaacaaccttaatttgctactggttaatcggaatgccactaggtactattttggctcgcaccgattggatcgttcagccgatggcggcggcaggattttggctgacattctgtgtctgcttaagtttagccgcagggctatttttctactttatgcggaaaattcaggctatgccagaagagattttaattaaaaaactagagtctattaaatagcacttaaagttatgtctatcctttattgtaccagatagggatagacataactttactcattgtcattttatattaggtattcatatatagctgaattatccagcttatctctttatcatttatccgatacccctctttcaaattcggcccacaagagttcgaaccaataccactcattttataatcgacacacagaatgtgatacggcgatttttctagctcgtaatgatgttttttcagggtcaattcttcctgtgtataaggggaaaaattgaagctgaacggctgtggtgcggtaatctcgagatcttggatgtgaagatattcacaaccgtagtgactgccgttttcctgtggtttgaagtagtcttgatgattttgctcggcagtggtttggtatagacctagtcggcttgcgtggtgtttgtcgatgtaactttcactctcgccatagccgaaatgtcctgatccatcaggaagatatggggcgtgatcgcaccattcccagataaaaccaccgcaagcccctgcatatttttcaaaggtttggaaataatcttctaaatcaccgttagagttccccattgcgtgcgagtattcgcagagtaggaatggtttggtttgtggctgttcaaaatagcgatccatatcttctgtgctggcatacatttcgctatgaaaatctaacggggtaagatcattttgatgttcagaatgttgataaatggcactttcatagtgaaccagacggcttggatctcgctgtttgatccattttgcactggcttcaaaattttccccataacctgcttcattacctagcgaccagatcagtactgatgggcgatttttatctcgttctacattggcgtaggtacggtctaagatcgcttgtttgtagtctgggtgtcgggcgaaatagcagaaattgtctatcgtttgttgctgaatacgtttgttatcatcttgttttgctacattcaacaaaatgctgtgttcaggcgttggaacgtattgcatactggcaccgtgactttcgatgtcactttcgctaatcaggtagaagccgtagcggtcgcataactcgctaaaccaaggggcatttgggtaatgggcggtacgaatagcgttgatgttatgttgtttcatcagtctaaagtcctgctctgcttgttcacggctgataacataacctgttaggggatcgctgtcgtggcggtttaccccacggaatttgatcgggtggttattgagtaatagtatgccgtctttgacttctatgcgacgaaatccgaccgcttgttcaatcacctcgtttccataggaaaggcgtaaggtgtaaagttgtggctgttcggcattccagagctgtggtttgtcaatttttaccttgaagtgatcgcttgtctgttcggcgattaggcgatgttgtggatcaaacagttggaaagtgagctgttgtggagattgcacaaaggtacattcgaccgataaatccgcttgatctaatgcttcggacaggctggttttgataaagaaatcttgtagataattttgttcacgttccagcagataaacatctcggaaaatccctgacatacggaatttgtcctgatcttccaaatagctaccatcacaccatttaagcaccacgacattgagctgattttctccagagattaaaaagtcagtgacatcaaattcgttcgtacaatgactgacttgcccatagccaacaaattgttgattgagatagagataaagacaagcgtccaccccttcaaaattcagtaaatagcgttttgtcgatttaggctcatagtggaatatccgttgatatacaccgcaaggattatcgtgtggcacataaggcggatcgaaaggaaatgggtagttgatattggtatattgatgttgatcgaagccttgtgtctgccagtttgatggcactggaatgcgatgctcaaaaggctgagaaagaaaattttcaggtaaatccatcacacttgtaaaatagttaaattgccattccccattgagcagggtaaataggctagattgttcacgctcaaggggatagaccttatcttgtgtcgcaaaggggatgaaataggcgtgacggggtgtggtgttaatgtgaagtaaagtgggatcttggtgataatttggtaacggcataacatcaattccattgcttagaaatggcaaaatgctatcactcgcaatccctgacttcaatctattgcaatgtaacattttagaaatgtgatgaagctcacaattatttttatgttcatttctaaagttatagtttacaaccacattttaccaattcttaaactcatatatacaactgctttcaatacaaaaaaccattaatttcttaatatttggtgatcacaatctcactgcttgcaaaactgactttaagtgtattactgcgacattctaccttaaatatctgttcattttggcggatttcgttttcacagggcttccctgccattagtaaggcaatctgattttcggcaatttgtagggcttgctgttgctgaaaaataagcgcgctttgcttattttgcgtatgttgccaacggctataagctaaatatatcactgaaaaaatcaacataacgaccattaatgatgtcaggctttctgctttaatgggcttattcatttgctaatatgttccgtgaataaggcaaatagtgccaagatgaaaatttattttccagatgttgaataacttcttttttataactgagatttctttcttctcgtaaattatcataggtggaataaagtgtgccatacattctttttcttcctgtaagatcaaataaataatcggtaatgacaataccgtaaaaatctttttctaacttttcattaatatcttgtaatgcaatcacaatttttggattctctagactactttctggcaactccgctaaatgattgattttatatatttccgattgataaggtaataaattcaaccagttttcaattttatccacttgaatatatttttctttggttggtttaaaaggatcaaaaatagatgaaaattgacaatgaaaactgtatttcattaccttaaactcaaaaataacattagtctgtttctgattttggcattctatttcaggatctattgctaacttttcaataagttgatatttatcggtaagatattgctgataatagaataggctcactttttcttgttttaataagctatctttattgagaaaaatgactgcaaacagactgcttaataatatcaaggtaattaataaactactggctgaataataacgtttcatttatcacttccatttaataggtaactataagcggtagctttatatcttagttggttatctttgctagacgagagagccagttctattttcaataatctattctgctcaagccactcaaaagataaattttcgacattataatcagacatatctgacatttttcgccagttgcctttttggcaatttgttagaattttttcacagtctgcttggtaacagaactgaatttgactatcttcataaataaaaatcgcttttttctcaaatttaaaaccaaaaaattcttggctcacatctttggtattatttacaccatttgtttcgcaagattgtttcttatttcgattacctacacagccatcactgcttaaatcatagaaaaacattagacaatttggattgttcagggaataacgcttatgattattttcaaataaatgataatttgtttcttttctattttgtccttgataattaaaatgttgaatatgttgttgaaaatattcaagtaattgatgagtatgtttttgcaaattcaataattcccgttgtttgatttgatttcgatagctatcactataaaaagaagataaactccataaaataatgcaacctagaaataatgataataatatttcaaccaaactaaatgcgtgattaacaactggtgcgtttgcctttttgaataacattaatcactccattttgttccacttgtaatatttcatagattttatttaccgtaactcttaagcacttcgactctaatcgcccagactttccatcaacattaataaaaactttaggatataaactattatttttgactacggcgttttctgtttgatagagataatagcttttttgaatatcacaacttgcgatatttaaacagttacaagcgatctgtttatcactgactttttcaattgcgaccatacaccattttttatctgctaaattctggctgatagaaatagaataattatgtttttgataacgtgctttagcttgaatttgataaataaaagactttatctgatcgatttcattatttaaaacgatatgatcttgtaaataaaataaggtgggggaaaagaaatagagtgcgattgccattatgctcatcgcaaataaagtttcaataatagtgatcgcacgaaacataatatctctcccaaagtgagagagatattagatgttgaaaggattttgtaaatcggcaatttttattttttcgacatagatcgaaaaattagaaagatgttgtatcttggaatagacctacttttaagtctgtggcagtatagataattctgccatcaacttcgacttcgccatcagccagccccatcacgagcttacggttgatcactcgtttcatattgatacgataaatcacttttttggcagtcggtagaatttgccccgtaaatttcacttcgccaacccctaaggctctgcccttgcctttaccgccgacccagcctaagtaaaagccaaccagttgccacattgcatctaagcctaagcaaccaggcattacaggatcgccgataaagtgacagccaaagaaaggcagatcttggttaatatctaattccgcttcaatataccctttctcaaatagaccttctttgtcggtgattttggtaattctgtccatcatcaacattgacggtgctggcagttgtggaccttcgctaccaaaaagttcgcctcgtcctgacgctaaaagatcgttgtaatcataacttgatttgatgttaggtgtacaagtgttcattattttgttcctgtaataaagtagaaaagtccgttattgacggtttatgttacgtttgcttgataaacacatcttaacagacttttaaaatagcgaacagttgtaagctgacttgtcggatcagtgaccctttaacagtttgcgaattttgtggaaaatcgaaccgcttgcgtcttcattttcattctgttcgatcccttgatgaactaacgcgaaaagtgattttttctcactattttcaggtagatcttcatcataaaacggatgctgtaacagaatttgtaaggcttcaaagacatcttcgaccgcccaaatatgaaattttcctgcttcaatcgccgataatactgcaggttttaagctcaaatgggaaacgcataccgcaggaataatcaccccttgtttccctgttaattcccttgcttcacaaacattgaagaagccttcaattttctgattaacaccgcccacgcttaacacatttccaaattggtcaatcgcccctgtcaccgcaagggattgtggcaacggcaacttggttaaggcactgataagcacgcagaaaatggctaacgatgaactatcaccatcaatttcaccataagattgctcaaaggcaacggacgctgaaaacggaagctgtgtcggtaattccagtaaatttgccaaacaagattgagcgataataatccctttagagtgaatattgcccccaagttccactttgcgttcaatatcgtgaatttctccatcaccatattgcacgttacagctaatgcgtaatggctcaccaaaactatggggaacgccatcaaactcgaccacagataagccgttaatttgcccgatggtttcttcttccgtttcaatataaagctgatgatttaaaatatcatttaaaacaaatttatttaatacgccagattgtttttctaaataatcaaaataatcttgaatatggttaaattgagtttgttttggataaaaatgttgtaagcctaataaatgtttttttaataatgtcggtgaaatagaaattaatgtctggttttcactttcacgaatataataatgtaaaagttgatttaagccttttttagaaaaggttctattgagatattttttagctgaagattggatatagctaccccattgttcgctattttcttcatcaatattcaaatacgactcgatttcagcatattggcaaaattgatataaatcttcatcataattatgcaaagtcgcaatatcatctcgactacccactaatatcaatttgaattgagattgaataggcataattgcttcaggtaattttcccgcaataatcgggtcaaactgcccaaataaaagagcttgttttaatttatcccattgcacaatatctaataataatgcactcacatttaaaatcagaatacccttatgagcttgctcaattgcccctgccaccgttttaatttggttttccttttctaaataaaggctatatccaaataaactttggtgattaaattctgttttcaacacagtttgacaatgcaaattttcaaaatagtccgtgatttcatttaaaaattcgggaaataattccgttttcaaaatgagtgccgaaccaaattcactcagggcaaattgttgcattgcctgctgtgtatttggttgaaaatccaaaaatctcaccgcttgatcggtctgtttgaaaggatagtgaacgcttaatgattgcaacgataatggagatacttgcacaaatttgcctctttatagaaatttgcttcattatacctataattacgctatacttcacaaataattcggaggcaaaatgcgataccaaaaacttgaaattcaagaagcaagttggaaatggaaatacttgctgaaaaaatatcgtgaaggcgaaaatatcaccaaatacgacgaacagagcttgatcgaattgaaagttcaattattaaccaccttacaaaactcgcccgaagagatcgagcaatggattaaggcggaaatgacatctgagcaacgcaagaaaatgcgtcaatctattcgagcaagacgcaagcgttttttcaatgccgaaaagcaatctacccgtaaaaaatctatcgatttagaatacgccagctggcaacgcctgtccaagcaagccaaagaaatggatctgaccttgtctgaaaccattcattatttgatcgatgaattagagaagaaacagatttatgcagagcaagtggataagatgaaagcaaatttgaaggcgttgttgggatagcgtcatttaaaacatagggagtaacaggcaaaatggcccctaaaaagtagctttgaattgtgctttgtgtaattacttccctttcacctcaataatcatcacttccgactgtgaacctagtcgcatcggtatcccccaaaatccgtatcccgaagtaacaaaaaaatgtccattaccgattttttcataaccgtgagcaagtcggtaaataaagtgagtaatgatattcgctgggaaaatttgcccattatgggtatggcccgacacttgaatatcaataggcagttgagcatgttgctcaatttgtgttgggcggtgatccattaggaaaacgggtaaatttttatctaccagagccaataactctgctgtttcagggcgatttttcactaattcatcattacgaccgatgatcgtaaattttccgtctaaagtaaccgcttgatcccatagcacagtaatgccagctttagtgatttcttgataaatttcagcttcagccccaaaaaaatcgtggtttcccattgtagcatataccccaagcggtgcttttaactttgccaaatgcggttgcatattttccgccaaataggcttcaacattatcgtccataatgtcgccagggagcaaaattagatcaacttgttcttgattaaagatggttgctaacttatctagctgtttccccccgaaaaatttccctaagtggaaatcgctggcgacgccaattttaagtggctgtataggtttatctaatgtgacttgataatgcaccactttggttgaataggcgttgtaaatagtcagcccaattaacccgaataaaacagggatatagcttattttaagccagcgattaaggctattcggcgagaatatctgtttgccgacagtataaatcccccaaaaacagaagctgatgaagaagataaataaaagtaatgtgagtattaaagcaattaagcggaagtttggcaaaatgcgtgtaacgtgcaatattatcaacagatttgcaacgatatagatagaaaatgtaacgatcttacgacttctatttgatagatcgcctaaccaagttgctgttttagaaaagcaaaagagcagaaattgaagggcgataactgaaacggttgtgataatgtaatagcggtattccatatttattctttccaagaaaaaaagcccaaccaaaacggttgggcttaaagtatagcaaatacaagtgtaaggagaaaataagtctttaattagcttattttgctaatttttgacgaatcgcatttgctaattctaggctaactttttcaaagtgagccatttgtctttccacgatttcagggatagttacacctgataaacctgctgcaaagttacctgctaagcgatctttttcttccgctgtgaacaagttgtaaagtgcggctggttgtgagtagtaatcttcatcgtactcacggaagttaaagtgtgcggcttcacgctcaatttgtaatggtaattgatcgtgggttggcacataagtgtcaaaacggttcggtgcatagttagggtggttgccaccgtttgcatctacacgcattgcaccatcacggtgagtcgtgtggtatgggcattttggtgcatttacagggatttggtggtggtttacacctaaacggtaacgctgtgcatcttggtaagagaacagacgaccttgtaacatacggtctggcgagaagccgattcccggaacgatgttagatggtgcaaatgccgcttgttctacttctgcgaagtagttttgtgggttgcggtttaattctaatacacccacttcgatcactgggtaatctgcgtgtggccatactttagttaagtcaaaggcatagttatgtttgtgagcatctgcttctggcataatctgcacttgaacagtccaacgtgggaattcaccacgctcaatcgcttcatataaatctttttggctagactcacgatcttcacctacaactttagctgcttcttcgttagtgaagaatttgtgaccttgttgtgttttgaagtggaatttcacccagaaacgctcgttgtttgcgtttacaaagctataagtgtggctaccgtaaccgttcatgtgacgtaaagtcgctggaataccacgatctgagaacaatgtcataatttggtgcattgattcagggtgacgtgaccagaaatcccacgctgcatttgcatcacgcaagttattttgagggttacgtttttgtgtatgaataaaatctgggaattttaatggatcacggataaagaatactggtgtattgttacccactaagtcccagttaccttgttcggtatagaattttaatgagaaaccacgcacatcacgctctgcatcggcagccccacgctcgccagcaacagttgagaaacgtaataatacttcagtttgtgcacctggtttaaataccgcagctttcgtgtatttagtaatatctgcagttacagtaaatgtaccgtaagctgctgaacctttagcgtgaaccacacgctcaggaatacgctcacgagcaaagtgtgctaatttctcttgaaaccaaacatcttgtaaaagaagtggaccgcgtgggccagctgacattgtgttgtcattatcaacaactggcgcacctgctgccgttgttaaggtttttgatccgtgatcaaatggacatttagacatagtgaattttctccaaaaatggcttattaataggttacgagtattatcattgatagttataagtttgtaaaactattgaattaataaaaaaatactattaattttcaacgccaatctttatttggtttatttataaatccgcctcatcaccatgatcttgtaaccattgtttgcgatcttcagcccgttttttagcaagcaacatatccattaattcaaaggttgaaacctcttcatcatcgctattatcttctaaggttagctgaactagacgtcgtgtatttggatccattgtcgtttcacgcaattgacttgggttcatctcacctaaacctttaaaacgttgaacatttggttttccttttttcttcgcgagacgagttaaaatagcctctttttcagattcatctaatgcgtaatgcacctcatctttaccaatatcaatacggtaaagtggcggcattgcaacataaacgtggccattttttactaatgttgggaaatggcggaggaacaaggcacacaataatgtggcaatgtgcaaaccatctgaatccgcatcagcaagaatacaaactttaccgtaacgtagttggcttagatcttcattgtcaggatcaatgcctaatgcgacagcaatgtcgtgcacttctgtagacgcgagaacttgatcaggtgatacttcccaagtgttgagaatcttacctctaagtggcaaaatcgcttgaaactctttatctctcgcttgttttgcagaaccgcccgcagaatctccctctacaaggaatagctcagtacgtgttaaatcttgtgagatacaatcggccaattttccaggtaaggcaggcccactaaccaatttttttcgtacgacttttttttcagctctaaggcgattttgtgcagaactgattgccatttcagccagttgttcggcaacttgtacgttttgatttagccataaactaaaagcatcttttacactattttcaacataactcgccgcttgtcgtgatgataaacgctctttggtttgccctgcaaactgtggttcttgcattttaagcgatagcacatagcaacaacgtccccaaacatcgtcggcagttaatttgacacctttaggcaacagatttctaaaatcacaaaattcagccatcgccttaaataaaccttggcgcaaaccattgacgtgtgtgccgccaagtgcagttggaatcaagtttacatagctttcattaatctgctcgccaccctctgtgagccagcttaatgcccaactcacagcttcagtttccccaatcacttcaccaacaaaaagaggatttggcagatattcatattctttcaatgcatctgttaaataatcacgcaagccatcttcgtagtaccacgtttcttgggtattattgatatggtcggtaaaattgatcgttaatttcggacaaagtaccgctttggctcgcaatagatgacgtaggcgactaaccgaaaacttcggcgaatcaaaatattttggatttggataaaagcgaaccgttgtgcctgtttggcgttttggacaagaaccgatcactttcagctcttccactttaacgccatttgcaaaagcaatggtataaatctcgccattacgtttaatggtgatctcaacactttcagaaagggcatttacaaccgaaatccctacaccgtgcaaaccgcctgaaaaggtgtaatttttattagagaacttaccgcctgcgtgcagttttgttaggataagttccacccctgaaattttttcagtcgagtgaatatccacaggcataccccgtccattatcaacgacttcaagggaattatcgctatgtaagataacatcaatttgattagcaaaacctgataacgcttcatcgacactgttatcaattacttcttgccctaagtgatttggacgagtggtatcagtgtacatacctgggcgaagttgcacaggttcaagatctttgagaacggtaatttcatcagcaccgtagcgtttttctgacataagtatctctttacagcctataggaaaacagagaaatcactctagtaagtttgagcgattagattcaatgaaaagattctttatattgattaaatgaaagaagatatatatggaaaatcaatcacgaaaattattaaattgaagaggctgccctaattcagcatttttcacaagctgtattgtcgattgtaaatcatcacgggattttcctgttatgcgtatggaatctccttgaatttgagcttgtaccttgattttagagtctttaataagtttaacaagctgcttagccatatcggacttaatcccttgttttaatttaatttcttttgtgtaaagtttaccatgatgttcactttcagaaggaatatctagggaagtatgttcaataccacgtttaatacagcatcctattaaaatttcaattaactgttcaagttgaaaatcagattctgtagtaacccgtataagttcatttttttcattaagttctattgtggcatcaactcctcgaaaatcataacgtgtacttaataccctatttgcattttctactgcattgcgtacttcatgtatggtaagttcagaaacaatatcaaaagatggcatcttattctccttctatgaaatcaaatcagagttttttcgcaattctaccacagcattccacaaactatgaaattaattcttataagatttcttgatgtattttattagattgaagaattgttgacgtccaagtctttaaagacgaaggctccaactagctccgattgattgttataggctaccctcggtgagctctttctgctgaacacttattatcaagtaatcacaaacttaacaagattgaaataacttacgctatttgtaccttatatctccgcccgaaagggtaagttttatggcacatagctaataaaagccacctcaatttctcaaggtggctatattcaataaatcaacgcaaattacgcttgacctttcacttctttacgaccattgaaaggtgctggtgtacctgctgctgccaatgcttcttcgatacggattaattggttgtatttcgcaacacggtctgaacggctcattgaacccgttttgatttgacctgctgctgtacccaccgctaaatcagcgatagttgcatcttcagtttcgccagaacggtgtgagataaccgctgtgtaacctgcatctttagccattttgattgctgctaaagtttcagttaatgaaccgatttggttgaatttgattaagattgagtttgcgataccattttcgataccacggcttaagatcttagtattggttacgaataagtcgtcacctactaattgaactttgtcacctaatactttagtttggtacgcaaaaccttcccagtctgactcatcttgaccatcttcgatagacacgattgggtactctttgcataagccttctaagtagtgagtaaattcttgagaagtgaatgatttaccttcacctttcatttcgtataaaccgttgtctttgttgtagaactcagaagacgcacagtccatcgctaaagttacatctttacctaaaacataacctgctttttctactgcttctttgatacaagctaatgcatctgcgttagaagcaaggtttggtgcgaaaccaccctcgtcacccacagcagtatttaagcctttcgcttttaatactttagcaaggttgtggaatacttcagcaccgatacgaagtgcttcttttaatgttgatgcacccactggttggatcataaactcttggatatcaacgttgttgtctgcgtgctcaccaccgttgatgatgttcatcattggtaatggcatagagtacacgcctggagtaccgttaagctctgcaatgtgagcataaagtggtaaaccttttgatgctgcagccgcttttgcgtttgctaaagaaaccgctaaaattgcgtttgcaccaaatttagatttgttatctgtaccatctaagtcgatcataatttggtcgatttcagcttggttagatgcatctttacctacgattgcattagcaatttcgttgtttactgcagaaacagcttttaatacacctttgcctaagaaacgtgctttgtcgccatcacgcaattctaatgcttcgcgtgaacctgttgatgcacctgatggcgctgctgctaaaccaacaaaaccaccttcaaggtgaacttctgcttcaacagttgggttaccacgtgagtcaatgatttcacgaccaattactttaacgatttttgccattgttaatatcctctatgagagttaatagttaatgttgaaaagacttgcatatggtaatgggattttacaaatttgtcttgtaaaaaagtgatgagcttcgcaaaaatttaaaggatatttgatcgaaaagggatttttctaaattaagaccaattatatattcgagtattaaataccgatatagacttttttctatcatcattaatatggactaagctatataacatctaatctacttttacgatcactggcacaaattcttccttacgtaagaaattttgttctctaaagttaatcggaaaatggcaggcaaattcgtgttggcggaatttgcgtagtggtggtttaacgacacattttttctgcgcaaaagggcaacgaggcccaagacggcaaccaataggcatatcttgtaacattggaactgagcctttaagggtattcaagcgacctttaaaaggcaaaggtttagaaaaatcgggtaggctatgcaatagtactgcggtataagggtgataaggggtttccataatggtttctttctctgcaatttcaacggtttgcccgcagtacaaaacgttaaatgaatctacccacttgtaaatactgagcatatcgttactcactagaataatagacgtaccaagatttttgttcatactggaaagcaagcgataaatttgtagctgtgtggtcgattccattgtattggttggttcatcagccacgagcaagcgaggctgatttgccactgccattgcaatcatcactttttgtgcttcaccttcggtaatatccgttggatagctttgcataatatctttatgatcttttatccccactttgtgtagtaattcaatggcttttttctttttccagccaaaacgttcccaccacttgcctttaaagcggatagtttcgattaattgtttaccaatacgttcgcttgggtctaagcaagagagtggatcttggaaaatcattgaaatctgatcactaaccagttttcggcgctgatagggggaaagtttcagtaattcaatatcgttaaagcgaaagcggtcggcagtaatgatccactcgtctttgactaatccgcagatcactttagcaattaaactttttcctgaccctgattcgccaactaaaccacatatctcaccgctatcaagggtaagattgatattatctaccatttttatacgcccgtttggcgtatcaatttcgatacttaaatgtctaatatccagtaatgccattgtttcccttccctaataacgatatttttcaagcacccgtacaatgctgtttccaagcattgtaatgataagtagagtaaaaatgatagcaaatccaggaagaatgaccgtccaaggggcaacataaattaattcaagagaatcgcggatcatcgctccccattctggcgttgggctcgttgcccccagtgaaataaagctcaatgcactgatgtctaacacggcaataacaaaaatatgcgcaagttctttgacggcaatcacagttaaattaggtaagatcacttcacggattaaatctcgttttcttgcaccctctaattttaaagtgatgacatattctctcgccagctcccgttgggtcgtttgataaattttatggataaagtgaggcaacatagcaagaaaaatggccaacattgcattaatgagcgagacctccattaaagttgcaatgatgatggcaatcagcaaaatcggcgtaaataaaaaggtatcaaaaagatgactgagaataaaaatagatccactccgttttgtccctgcaatcacgccaagaatgccacctaaaataccgatagcaatggtaatgaccaatgctgaaccaacggtgtagtagaagccgtagaggacgcgactgaaaatatctcttcctagatcgtctgtgccaaaaaaatggctaatctgaccgctatcactccacgatggtggcattaattccattccgctaaattgccgatcggctgcataaggggcaagtaaatagccaaaaaaaaccaatcccatcagaagaataaagagattaaggctgatgagtgcaaaggtgtctttcctcaactctatccaaaattggcgtaaatacgcagattctcgaaactgttcggggtcttgtgcgagtagcattctttattacctttttactaatactgaatataacaataacatcttttactcttaattcattgtttgatagacagtatagcattctattcttgttctaacatcgccaacaaatgttgtttcaacatcgcctgttcttcctccgccaaagccccattttgctgattgctcaccacaaaaaaatcctccacccgttcaccaatggtcgtaattttagcgttaatcaaattcaacttaagctgcccgaaaatatacccaatttgagccaacaacccctctcggtctaaggtaaatagctcaaaagcggtctgatttggctgggaatttgctaaaaaacggatcttggtttttcgcttaaacgcctgatgtttaacggattttttacttggattaaacactttctccgtattcgcaagcaaagttttaaccaatgccgactgaatttgttcacttcgctcatcatcgagtggctcgccgttcatttccgtaataataaaactatccaacaccaaaccatgatcgctcgtaaggatttgagcatcgtggatactcactttcttctgacttaacgtctgtgcaattctcgcaaaaagctgggcttggtcttggcaatgcacaaaaatttctgtcgctccccgtgcatactgattgctaatcaacaccatcggcaacgcaggatcttttaaataatgcaaggcgtgccaataaagctgtgtcgggctgtttcgcacaaaatagctttcaggacaggattgccaaaattgcaacagccgtgttttttgttcagccgaaagtaacgcctcaagttgtacataggcttgctgttgatgggcttggctcagttgctgatgattaatcgtttcctcactgcctaactgcaactgctgttcggtaaattgaaaaagtttaaggaaaagcgaccgcttccaatcattccaaagggtttcattcgtcgcacaaatatccgcaacggttaaacaggttaaagcagctaaagcggtcggatttttcaccacatttgcaaaagttttcaccacatcgggatcgtgaatatcccgacgttgtgccgtaattgacatcgtcaaatgctctgccaccaaccacgccatataatcactttgctcttgagaaaagccgtgttgttgagcaaaagcacgcatatcttccgccccaactttagcgtgttcgccctctctgcctttagcaatatcgtggaacaaggctgacaaatagagcaacggacggtctgccagtgtcggaaacagacgacaacaaagcggatgtttttcggcattttcctgttgcagaaaactttctaatttaagcatcacctgaaccgtatgctcgtccaccgtataaatatgaaaaagatcaaactgcatcaagccttgaataccaacccattgcggtaagtaagcggttaaaacgcccaactgatgcattggcataatggctcttttaaccacatcaggctgagaaaacagccgaataaagcgatgtcgagcttgaggcagttcacacaacggctggtttaaggtctgtaacgccagccgaagttgtcgcaacgtcgtactggctacacgcacctgcgtatgctgagtgagatagaagaaaagatccaaaatccgctcaggttgttgcttaaaaatcaaagtgttactacaaattagctgttccccttgcaaataaaaatagtcatcaagcggctgtttttgctgtacattttgcaaagcctgtagcacctcttgatgaaaatgattgagcaacaattgcgttaattgcgaaatagattgcgtcgcctgaaagaaatctttcatcatcgcttccacaggctgattaccctcgccctgatagcctaactgctcactcagttgtaactggcgatcaaaccgcaagcggttatcgtaacgctttaattgcaaatgcaaggcaaaccgcattctaaataacgtatgttgagcctgctgaagctcaataaattcttcaggatagagcaaaccccgactaaacaaactctctaggctatatagcccataatggcgtaacataatccaagagagcaaatgcaaatcccgtagcccccccggactatgttttaaatcaggctcaaggttataactggtattatgataacgggcataacgttcatttttttccgccatttttgcttcaaaaaaggcttgaatagaccaaaactccgcgtggaacagcttgctcatcagctgttgccacaaggcttcattgccaagcaaaaaacggctctcaaacatattcgttgtcacagaaatttccgctctgcccacctcaacacactccgccaaggttcgcacactcgcccccagctgaaatttgcaatcccacaagaggttaaacagttgatttaattgattttgcgtctgttcatctaaaggctgttcactcaacaccaaaatatccaaatcagacagcggaaacatctccctccgcccatatcccccgactgccactaaagccaagtcctgccgctccatcaacccaaattgttgccagagcgttgtcagtaaatcatcataaaaatggctacgttgttcgagtaaatttttgatatcttcagtactaaaaagggatttttgtgtgctattaaattgctgaagctctgtttttaaagtttgtgtatcaatcatagcggtgagttttagcattattttacgaagaattgtaatggatttctgagcgtccaccaaagaggatttttaaagtaaattgtatgaataacaaaatctctttttaggctgaaattcccaaaatctcaccacttattctatgttagaattctagcaaattttcagacaaggattttcaatgagcaaacagggtaaaccatttattttacattcccccttcaaaccctcaggcgaccaaccgactgcgattgccaaattagtcgagggattgaatgatggcttggcacatcaaaccttgctaggtgtaacaggatcgggcaaaacctttaccattgccaatgtgattgcgactttaaaccgtccagcaatggtgcttgccccgaacaaaacccttgcggcacaactttatgccgagatgaaagcctttttccctgaaaatgcggtggagtatttcgtttcctactacgattactatcagcccgaagcctatgtgcctgctagcgatacttttattgaaaaagatgcttctattaatgagcagatcgaacagatgcgactgtctgccaccaaatcttttttagaaagacgggatacgattgtagtcgcatcggtgtcggcaatttacggcttgggagatgtagatgcctatatgcagatgatgttacatctgcaagtgggggaaatgatcgaccaacgcaaaattctctctcgccttgctgaattacaatatactcgtaacgatcaagcctttcagcgggcgactttccgtgtgcgtggtgaagtgattgatattttccctgccgaatcggacggtgtcgctctgcgtgtggaactgtttgatgatgaaatcgaaaacctgtccttattcgatccgcttacagggcataatttagggcgagttccccgttatacgatctacccaaaaactcactacgttacgccgagagatcggattttagaagcgattgagcagatcaaaaaagaacttgccgagcgtcgaacttactttatcaaagagaataaattactcgaagaacagcggatcgcccagcgtacccagtttgatattgagatgatgaacgagttgggctactgctcaggcattgaaaactactcacgttatttatcgggcagaaaagagggtgaaccgccaccgaccttgtttgattatatgccgtctgatggcttgctgattattgatgagtcccacgttaccgtgccacaaatcggcggtatgtttaggggcgaccgagcaagaaaagaaactttggtgcaatacggtttccgtttgccatctgctttagacaaccgtccgttgcgttttgaagagtttgaacgcttatcgccacagacaatctatgtatcggcaacccctggaccttacgaattagagaaaaatcctgatgtaatcgaccaagtggttcgtccgactggcttgttagatccaattatcgaagttcgacctgtggcaacgcaagtggacgatttattatcggaaattcataagcgtgtagcagtggacgaacgagtgctagtcacaacgctgaccaaaaaaatggcggaagatttaaccgactacctcgatgaacatggcgtgcgagtgcgttatctacacagcgacatcgacacagtcgagcgggtcgaaattatccacgatttacgaatgggaatgtttgatgtgttagtcgggatcaacttgttgcgagaaggtttggacatgccagaagtgtcgctggtggcgattttagatgccgacaaagaaggctttttgcgttccgaacgttctttaatccaaactatcggacgtgccgcccgaaatctcaacggcaaagcaattttatacggcgaccgcatcaccaactcaatgcaaaaagcgatcacagaaaccgaacgccgccgagagaaacaacaaaaatacaacgaagaacatggtatcgtgccacaagcgttgaacaaaaaagtcggcgagttgttagatattgggcagacggataaaccaaaacgcagtaaaaaatctgcaaaatcaagtgatgatcagaccgcttatattccgaaatctcgtaaagagttagaaaaagaattgaaagtgcttgagcaacagatgcgagattttgctaaagatctagagtttgaaaaagcggcagcggtgagggataagattagggagttgaaggcgtatttgttagaactttaaaagtaatttaaattacttcataaagaatactaaccatattgagatttatacagtatcaatcacaaactcaaaccaatcaatcacatctttttcgtgaatgccgttggggattaacacccctgctttttttactgaattgggatcttgtgaaatcagtgggtgccaatcaaacaacggcttgccctcataaatcagtcgataggcacaggttttcggcaaccagccaaaatcgggtaggttctttttggtgagcttggtacaatctttttcgattttgaaacgctcaacgtagttagtacaccgccctgtattcacatcaagcaaattacatgcgacggacgtgtaatacagtcgttcccgtttgcctctgccttgaatatatttgcgataacaacatttaccacagccgtcacacagcgcttcccactctgcttcattcatttcaagcagagttttggtttgccaaaaaagcggtgtgatttgaagatttttttgcaacattaacgaatcacaaccgctgtgccagtcgcaactacaataaacatacctttgtcaccgcccatcgattgatattccatggacacaccgacaacggcgtttgcgccaacttttttcgcttctttttctaattcttgcaaagcttcttttctcgcactatttaatttgctttcataagcgcctgaacgtccgccaatgacatctgtgatacctgctaaaaaatcacggataaagtttgcacctgacacgacttcaccaaaaactaagcctttgtactcaacgatttgatggttttcaatatttggggttgtggtaataatcataatgttcctatttcaattgttgtttaagggattgtaatgcaatcgctctatgggagatttttttcttctcgacggtttcgagttctgcaaaggtacagtttttaggtgggtagaaaaagagtggatcgtagccaaaaccgtttgaaccacgttcttcacacaaaatttgtccgtaacattcgcctatcgcaattttcggggtcggatcagtcgggtgttgtaacatcacaacgcaactgacaaattttgcaatgcgatcttcatcggcaacatttgccatttcagcgagtaatctttggcgattggcttgatcgttcccttcttcacctgcataacgagcagaataaagccccggctcaccgcccaatgcttctaccgctaaacctgagtcatcggcaatcgcaggtaaccctgtcatttgtgacgcataacgagctttaatcagtgcattttccacaaaggttaaaccagtttcttctggactttgaatgccaaattcactttgggcaatcacttcaaagccaaattcagctaatacatcagccatttctttcacttttccttgattgcctgtggcaaggacaattttggttttgttcactatctctttcctcatattaaaatttctaaaactatgtgcattcacaaatacagcagggacacactgagtgtgtccgttatcaatatttttagacatattattgatttaattaacgccctgcggacacacgcagtgtgtccctaccttaaaaattgtttgctaggacgccaagcgtggcgaccttactaggtttaatgtcggcggtttaatacaaactcggatcgctctcattcggtcgggttttaaaacggcgatgtagccacatatattggctctgagcttgcataatctcgccttctacgaccttattcatcaaagttgcggtatcaacgtcatttttacactggctaaaatcaactggcgggctgattttgacggtatagcctgaaaaatcctcgtttcgcattggagtaaacggcacaacgatactatttgaagcagaacgtaataacattctcgtgccagctgtcgtacaggcttcttttacggcaaaaaacggcacaaagacgctgtttttgcgtccgtaatcgtgatcgggggcataccaaatggtttcgcctgcacgaagagctttaatcataccgcgtaaatctttgcgatctaacattgctttgttagaacgtactcgcccacgaaattgaatccaatccaacagcggattatcattaggacgataaacaccgatgccttgacgctgtagtccaatcattcttgcaccaaactcaagcgtcagaaagtgaacaccaactaaaataattcctttaccctctggctgatttttcagatgttctgccccctccactttacatagtttaagaatacgttcatctgaccaaaaccatgccatacctgtttcaataattgccataccaacggattcagcgtttttagctaaaatctcatcaatttgactagtggtataatcaggaaaacaaagttccaaattccgtttggcaattcgcatacggcgtttaccaaaacctaagcgagtaaacagtttgcctaagcccttaccgacttttactaacatagggtaaggtaagcataaaatcagtttaaaaattcctaatccgaaccataaaccccaatactttgggtgtaaaaaagctcgttgaaaagggggaagttgtttatctatcattatattgtttccattgatttcactgacaagcgaatccactctagtgcgatttttcgatgagcaatgaataaattatacacggcatcttcacttaataggcatcgaatcatctctgagggaatttcccctcgttcatctgcattataatcttcttgccactgttcagaataataattttctagttctcggattttaggtaaaagaactgtccacgactgctgaagctgttccattttattcattaagctacttgcttcatttaaaatctgttccatttcacgaattttcgccaagcgagcttctgataacatcatacctccaaaaaatatcgttagaattatagtcaaaaaaaccaaaaaagtgttaagtagatcaaatttttgaaaattgtttaaatttaggggttgaaattttagggggaaaggcatactttgaagctatccattcaacgaccaacaaggtcataacaaagaggtaaatgctatgacaatcaatatttcaagcaaacaaatggaagtgactcctgcaattcgtacgcacattgaggagcgtttggctaaactgaataaatggcaaactcagttaattaaccctcactttattatccacaaattgccaaatggttacgaagttgaggcttctattggaacccctgttggcgatttatttgcaaaagcacacgatgaagatctctataaagctatcaacgaagtagaatcaaaacttgaaacccagctaaataaacaaaaacataaaggtgaagcacgcagagcagatgatagtattaaaaaagcgaatgaagcgttatagatggcgtaaatatttatatctgagatagcatatccaagcactgttatttgtacatctatctctaattctaagtatcttcattttaaacttatggtggtcgcttagacgatcaccaaaatcaataagctggctgtttctagtttagagttagcatgcttcatttttgccacctcattaattgcggcaagtaggcaaatttgtttgctgatctgccaaaaactattctatttaaggggttgtcctagataactaacttaaactacccttaactaattgttttaaaatggaaatttgagattttaagttactgtgattaaaacgccattcgcattccttcaaatacaactcaaaatgtgctttgggaataccgttaaacttgcgtaaatgacgtttagcttggttcccaaaattctcaattccgtttacatgattttgtttttctgcgaaatgagtactgtgattgatacgaaaatgattaaactcactcacatcaagaacatcatagcttcgataaaaatcggtgtaaacaatgctgtcaggcttcaccttttctcgaataatcggtaaaagtgccgcagattgaatattcggtacaacgacggtatacaccttaccatcacactttaaaagcccgaatacagcggttttacccacagctccacgacctcgtttacctttgcgagtgccgccaaaatagctttcatcggcttcaatttcaccttcaaacatctccatatgtgggctgttttgatagataagcaattgcagacgatagaagtaataggctgctgtcgttttatttacatttaccagctcagccgctgttcgagcagtgacacctgccacaaacagctcaatgagtttattttgtttatgctgacttaggcgactttttctcatttggttattttaacctaaaatagagcttttagtcgttatctaggacagccccctatttaaaatgtcacatcatcaattggaaatacatttctttccttaattactcgacggattacatcacctagagattcaataacacttgtcgtataatatgccgaattcctgctcacctataaaaatacctgtatctagatgtattatcacagaaacaggtatttacacaaatttattctatgctctatagaaagttagaacttcatctctactgaaaggacataatttctaccaggggctgcatatcttgcgtaatctttcacattagtgtgctggtgaatagcgttaagtgaagattgacgtacggattcccaagtggtgtaacggtaattcatcaggttatatacgccagctcgtaccgttatgtgtttccaaggggtgatatatcccgttaagtcaaaggtatgccaagaacgtgttcttttcttcgtggcagttcgttcataattggcaaaaccgacttgttcattacctcttaactcatctggattttttccactagagtgtgtcattgtcaaattcacgccccatttttcatctggctgatcgtatcccacacctacaacatagcgagcaggctgaatggtgtctaacaatggagtgcgaatgttcatatacccaggataatttttcacctcttttactcgcattttgctataagctaatgttgtgtaaatgccctcaagaattttatcaaataccccattccaatctagcttaccaataagattaatgccgtccaatttaatatcttgcacattaaaatagttaatcattgattgagtttggtgcattctttctgctggagcaatcaactgcttatagtcatttttgaaataactgacttcaacgataccaaaatcacctttgaaagtcgcagcaacctcttggtttaaggatttttcaggagataacttctctgttttttggtaagcatcgctggagcctgctcttgcaccatcatagcgtaagccaaatagctcttggaaacttggcactctaaagcctgatgatgctcgataagagagcgataggaatgacgttggttttgcaactatgccaatattccacgcactgtttttataatcgccttgatttgcccagcgatgagtgctacggaatttatgcttatcgaaacggtaacccaaaccaatatccaaatacttggttatagcaaaattatctctcagagcaatgtagtgattatgccctttgattttacttgtagcacaatctgctttgcctgcaatagtgccagtatagtcacagacattttgagcataaatcttctgatcttttagctcatagatgtaaggattattttgataaccgttaccactgatacgatgccaagttcccacggaaaactcactcaaaatttcgtggcgttttaaagtggaattaaaacggtctgaacctaataacatatttaattgatgtttgcccaatcccgtttgtatggttttatctaacgatagctgaatggtgtcgtgtttttcttcataagaactttgctcatttttagtggaagaccaaagtttatcaagggttgcacggcaattcttatctacggttggatattcggaacagttgttctctctcaagcgggtagataaatcaattttttgctgatcgaaactcaaagatagactatcaatcaggcgattttcatcttgattggtataacgatataaagcacctaagcgatcacgagtgtgccactcatcaataaaacgagcttttgcccaacgtaaaccttttgatgatttcacaacaccgtccgtaaagtagttaatagcaacaccatctaaagcattatcacgatataaccctttagcattatccattgaataccacgtatcactattttttaaatctgatagctgccaataagcaggataggtcatatcgcgagtatcatagcgttgcttgctatgctcataaacaccagccacataatgttttggtgaaaggctataacctaatttaaccaaccaagaatcagatttatatttcactggatcaggcaaagctcgttcttcacctgtatattctttaccactgagttgctctgttatatacttctgaccatcataagacactccaacctgctggcgtggctcgcagttcaaacttggacaatcattcttaactttaaaccaattgctaccttgaggattattatctgcgagagccactctctgaatactcttagaacggctttctgcatccttatgagctttcgtttccttaccatcacggtgagtgtaaatcacaagagcatcaaagccattgtgactacccgcaaaagcaagtgagtttagccattgttgatttttactactgtaagcacttttggtatctaatccccaagattgccctggcttaataatgtcgcttacctctttggtacggaattgcaccgaaccgcctagcgagccactaccaaactcagaagaactagcccctttactaatttggatcgaacgcagattttcgtattctatttcattaatagcaccgcttgaggaacgtgaatattgacttacataggattgaatctgtggcaaaccgtctaatgccaagcccacacgattacgatctaccccgcgaattgagtagcctgtcgttgcacctcgtccctgttctaccacagaaatacctggatcgtagcgagtcagatctcgcattcctaatacttgctccttactaagagaatctgatgttttcactactttccctaagcctgtcacttcgttctcttttttatgtgctttctttttggtacctgtgacataaacatcgtttaattgtaccgcttgttctgcatagctttgtacggcaaagaggctaagaagagcaaggctaatcagatttaatttatttttcattgcaaattccttattatttttttacttgttgttttgcaccaaagacagcacctacactgccattgtctgatttatggaagaattgtccgccaagctctgctgccgttggaccatagaagccaccattaactgctacatcgctaaatttcacattgtcataacgtgaactacctgagtctagagcgaagccagcatctgaggttttagcttttccggtaaaaccattaccattaatttttgcatctacggtaaatacaggatttacaccgtttttatcaaataacttaccgcttaaatttttgttgccaaaatcaacatcaaattctgtgcgatagccagcctttctatcatcatctgctgtagcaacccagttattttcttttgaaacctgagcatcccaagtaccaatatatttatagtttccgccttttggcatcttatctgttgcggtacgttcgccttgtaggaataaactattatctttagctttttcgccctctgcttgttgccataattgaccaaacttcatatattctagattactacagcaggctacggctaccattgttttgccattgatttcaatagtgtgcttatttgtaaacccgctacctgccagctccattttttgtccatcaataatcaaaacagaggcatcgccaaaattggtaagttctgaaatactgaaattagttaaatcaattttggaggcatcaataatacgaacggtgtcaacattagagccattgtgttttgctgaaaaaacggcaaaaagagatttgtcgtttgtgataaattttcctgcaagttcttctgccttaggtccatagaaaccaccttcaagataatcagaagacttacctaaaattgcatcgctatcattcttggctattgctttacctctaaaacgatttcctttaagctctgcttcaatactataacgctctaatgattctgcatttgctgttttgctatttaattttccttttaatttttttgttgaaaaatcaacttcaaattcagatgtataggttctacctttagcatctgcagatgtcgctgctattctttgtcctggaccatatccattaaattcagggttactattaggtcttttggcatctaaattagcatctgaggtaaaatcccattcaccttggtaggtaaggactggcccctgcggtaattcttttgagggagtgatacctttataaaacacataacctttatcacgagtaccataatgaaatacatcaattgcataaccagaacgaacatacgtcatcttcttagctgctgttttatctactagctcgccataattttgataagctacatctttgataatatcgtggtttggtattttattaagatcttcatcagtaattgcttctagatttgagatttccgttcttcttactccattttgactcactggaacttttacaacataccccaaagcaggttccatcaattcccctaactgttctttttctttcttggctgtttctacatccttgtactcctctttagacatgcccgttgtcttattaggttgaacatcttctaaatcaaaacttccttttccgccagaacaagcgacaagaaacagcgaagtaaacgctaacgcatagggattaagtttaaaatgcatattgcctccaataataaaaacgctgcatttatttggttggttgggttacaaagccaattttggttagcccaacattttgagctaattcaaggactttcacgatatgttgatattccacggaaatatccgcagaaatagcaataacggtatttttattttcctgaaattttgtcagaaaagattgttttaattcttcttcatttactagcttttcgcctaaataaatgcccgtaggattaatcgccactctgaaaatatcttttgcttcatcttttttctcaacattggcggttggtagttcaagcgggatagattgcgttaatataggcattgtgatcataaaaacaattaataacaccaacattacatcaactaatggtgtaacattaatttctgacattaccgaattttcatttttatcaaaacttccaaatgccattatttattttctccatagtgatgtaataaatagataaataactcgtttgcgtaatgatctaaatcttgagaaagattacgattaaggcgagtaattaagttataagcaagcactgcaggaatggcgacaaataatcccattgccgttgcaactaaagcctctcctataggggcagatacggttgcaatactgacttgcccttgctggctgatgtccataagtgcattaaaaattccccagactgtgccaaataatccaataaacggcgcaactgcaccaatagaagcgagtgcaactaaaccgccatcatatttacgcaacgattgagtgatggcatttcgcaaatgcaatgtcaggaaatctttaaatggaagttgatgagataaatggttcttttctttagcttgatataattcacattgtttaaaagttagctgtaaaatatctgcaatttcagaccgcttgttttgaatatattgctctgcttgagtaagattttcagcagatttgactaattgaaaactttgttggttattttttcttacaccaatcattttaattaaacgaattaaaataatagtccaagataaaatactcattacaactaaaattccaaaggaaatggaaagtacaatatcttgttgttgaagaagttgaattaaattcataaattacctcaaataatttaggctgctgccccacatttaaaatgaatactaaaaatcacactgcctaccactgcactattatttattttggctggttgataggtgtgtcccgatgccattctgcttgcttgattatccaaacgtttaatacctgaagaagataaaatctctacatttgtcgctttaccattcgttcctattgttacctttaatttcacactgcctacatcatcagattcatcagaaatatctgaacaacgccctcgcattgcattgccataacccgcaccaagagaagcatctactttggcgtttccggtcacagacttactcccttcaacaccattttgatttccttgttgatgattttgggcaacttggcttgtgtttgtttttttatctgagtgcgctttaggcgataactctttatttttctctacttttttggtgagcttttctggggatttttttatctcttttttcacttttacttcaggtttctccccttttttaacgagatctgcttgtgaaacatctgctacttctgtactgagtatttgctctggctcttgtgtcacctctggctcactttcacttttcacttcaatgggttcttcgcttcctaaatttacttcaaccatttgtaaattttctaagtccccaaaatgattgagatctctatcccaagatagttgtgaaatcgtatatgccaacccgatatgaacaagagttacagataaaaaaatcgaaatgttataaaacctgttataaaaccattgcaacataatatatgagtatattagaataagtctagcaaccaaaataaaaatcattatcaacaattatatctgacaagtttgacaattacaacattaattcaaacaatgtaagcgccagttaagttactgttaataaaaaatcaacaaccttgacattgcttcatgcttttataggaacgttatgaatcactcgtttattagtgcaacacttttattagtcttagctaactactctatagcaaaactatctcaggatagtattactgaacatctaaatgataatagagtccaagcagaaaaagccgatatcctcattcacagccatcaatttaaggttcatcaaatcgctaaggaggaaacggataagagtagcattacaatgacttcaaaagagttggtaaaatatccagatttagtgataagagcattattgcctgcggtaatgcaaggtaatattgacaatgtcgaattgctttatcccatttaccaacagcttcctgcacaatttcacgatccaattctcaccaaatgggcatcggcaattgtggcaaagaaaaatcagcaacatacggaagcgatcaagttatatcgtcagatccttgccgaacaagcagatattcagcctgttcgtttacaacttgcggtagccctatttgaaaataacgaattagaggcttcagaagatcagtttaaaaaactgcgttctgaaccgcttatccccgaaattacccaacttatcgatcaatatcttaatgcgataaaccaacgagatcgttggacgttttcgggtggcgtgacttatcttaacgatcctaatatcaataatgcaccgaaagcaggaacaatctacggcaactcgtacgtactaaaactagaatcggcacgagaatcggcagaaggtgtcagttttaatttcgatctcggtaaaaaatggtcgtggggaaatggcttctttaatgaactacgtcttgctaccaacggcaaatactactgggataataaaaaatacaacgaaatgagcttacgaggcagtgtggggctaggttttcaaaatgcaaaatataacctgaggctgttgccatttatggaacaaacactttatgcaggtggctctaatcaaagtgatacattaagacgtttttctaaatcagacggtttaacccttgaaacaaactattggttatcacctaaatggcaactcaacgccaactatgaatatgccgaacaacgctatgcaagtcgcttgcacctcaatggcaattatcactttatctctggtgggttagtttatttagccaatgcaaaccaatattggtttgcaaatttaaactacaatcgcaccgctactcgtgataaagatgatagctttttccgtcggggaattagtttaggttgggggcaagaatggggcaaggggctttctactcgcctctccgtaagtgtagctcaaaaacgctataaaggggcaaggcttttcggcattattcaacgtaataaagaatatggcttcaatacatcaatttggcatcgtgccgtgcatttatggggaatcacccctcgtttaacctacaattttactaaaacgcaaagtaaccacattttttatagctatgataaacatagggtgtttattgagtttagcaaacaaatttaaacttattgtttgttatacctctgcacctcactctgcaaatctaatcctttcaaccacgccattttttctttgatctgcttttccattccacgttcggttgggaagtagaattgggtatctttcagttcaggggggaagtagttttcccctgcggcgtaggcgttaggttcgtcgtgggcgtagcggtattcttcgccgtaacctaaggatttcattaagttagtcggtgcgttacgcagatgttcgggaacatcgtaatccttgccttcttgagctaggcgtttggcttgtttgaatgcggtgtaaacggcattactttttggggcaacggcaaggtaaatcaccgcttgagcgatagcccgttcgccttcgtaagcccctactctggtataacaatcccacgctgcaagggcgacttgcattgcccttgggtcggcattgcctatatcttctgaggctatcgcaagtagtcggcgagcaacatacagtggatcgcctccagcggttaaaatacgagcataccagtacaatgcaccgtcaggggaagagcctcgaatggatttatgtaaggcggaaatcaggtcgtaatagcggtcgccacctttgtcaaaacgggcttggcgttcgcctaacacttcggtgagcaaggctttatccagtaattttccttgtggtaattgctctgccatatcgcacattaattcaaggcagttgagagaaaaacgtccgtcaccattgacataatccgccagcagttgaagcacatcatcttgaataatgagtttttcattgcctagtccacgttctttgtctgcaatggcattttgcaaaatttttagaatatcgaccgcttgtaatggtttgagaatgtaaattcttgcccgtgacagcaaggcgttattcagttcaaaggacggattttcagtcgtcgctccgataaaaataatggtgccgtcttcaatgtggggtaaaaaggcatcttgttggcttttgttaaaacgatgaacttcatcaacaaagagtaaagtacgtctgccggattgtcggttgagtttggctttttcgatggcttctcggatctctttgataccgctggtaacggcggataggcgttcaacttcggcatcaagttcgtttgcgataatttctgcaagggtggttttgcctgttcctggtgggccccagaaaatcattgagtggctatgccctgcttcaatcgctcggcgtaggggcttaccttcgccgatcaggtgtgattgtccgacatattcagctaaagtgcgtggtcgcattcgagcggaaaggggacgaaaatccgcagaaaaatcgaaagataagctgttcattagcgtaaatgcagtcctcggcgtatgtgtcgcatcagtaagaaaatccacggccataagataccgcttatgatcgccccgataatttcttgggtgttaaattccgcactgtgtagcactaattcgataaagaagatgaagaaacgaataagtgcgatatatgccatcacgagtaagctctgtaaccataacgagagattacgcaagataagatgatatttggcaacaaaatagatcgcaattgacaatactaaagcgtgaatgcctaaaattgagcctaagatcagatcccaaacaattcctgctaaaaaagcggtaccgacactaactttatcaggcagagctaatacccagtagataagcactaatacaacccaagttgggcgtaatccttgtaaatccacaggccaaggcataatctctaggacaaaagcgatgacgaaaatgaaggtcagcactaacatttggaagatcatattttcacgcattattctgccccttgctctgtgctgtgattaataccgttatcgacttctggctgtgttgctggatttacagtttcttcaggttcgacagtttcttctttttgttcatcactacttacttgttcttttttactatttttcaagcggtctaatgggtttagacttttacgtctttcttccacagcatcacgcacatcttgcggtgaaaggcttgatgcattgcggatttcttcgcttgttggccataacagtaataaataacgcaggcgatcaagtgaggcgagcggtctagccgttgctctggcaaaatggtttgaaccatcattttgtacggtttcaattacggcaacgggatagccttcagggaaacgtccgcctaagccagaggtgacaagcacatcacctttgccaatatccacggttcttggtaagttatccaaaatcaattcattgctgtgtccgttgccattggctattgctcgaacatcgttacgcaaaatttgtacgggaatggcgtgagtgacatcggttaaaagtaatactcgactactgtttttcccgacagaaatcacttgccccacaacgcctcgttcatcaattacgggctgaccaacaaaagcaccgtcactttgtccctgatttattactacttgttggcggtaagcgtccatttctgcggtcagcacttcagctacttttttatattcatcttggcgtaaaggggaactaagtagtaaacgtaaacgttggttttccactttgagttgatcgagtagcaataagtctgcgttcttttcacgcagttgttcttttaatactcggttttcaacttgcagtttttgactgtcgataaagttgttacttacaccgtctaatacggtgcgaggggtatttgcaaaataatacaagccactgaccgctgtttcgaggacattacgcatttggatcattgcactgcttctaccatcaagtaaaatcaggctgatagagatcgcaattgcaaagaatagtcttacgccgataggtggtgctttcgcaaaaattggtttcatatttcagttatatttaatggatcttgttaaatgcaaaatggacaatagccgttgatattgtccatttttatgctaataactcaaggttgaattagttgtcgtcactaaagagatcgccaccgtgcatatcgatcatctcaagtgctttaccgccaccacgagctacacaagttaatggatcttcggcaacgataacaggcacgcccgttgcttctgaaagtaatacatcaagattttgtaataaagcaccgccacctgttaataccattccacgttcaaaaatatcggcagccaactctggtggacattgctctagaaccccttttactgcatcaacaatgcctgttaaaggttgttcaatcgcttctaacacttcttttgagcttaacacgaatgtacgaggcgcaccttctgcaagattgtgaccgtgaacttccattgtgcgaatttcatcttgattttgaatataagctgttgctatctcttttttgatacgctctgcagttgtttcaccaatcgcagaaccatagtgacggcgaacgtaagcgatgattgcttcatctaatttatcaccaccaatacgcaccgaagcagaatgaacgataccgtttaatgaaagtaccgcaacttctgttgtaccaccgccaatatcaattaccattgaaccagcagcttctgctacaggtaagcctgcaccaatcgcagcagccataggctcttcaattaaataaacttcacgagcaccagcaccaatcgccgactctttaattgccttacgctctacttgagttgcccctgctggtacacacactaacactcgaggacttggacgcataaagttattgctatgcacttgtttgataaaatgctgtaacattttttctgtcacatagaaatcagcaatcaccccgtctttcatcggacgaatagccaaaatgctttttggtgtacgacctagcattgattttgcattactacctactgctgcaatactttttgatgaaccagcacgatcttgacgtaccgcaactaccgacggctcatcaagcacgataccctgcccttttacataaattaacgtgtttgcagtaccaaggtcaattgaaaggtcgtttgaaaataatcctagaaatttcttaaacataaaagggatccattaaatttagttaaaagcgaaataagcccatagacttagggcaaaaaattgggcataaatatagcaaaaaagtcctaataactccaacgaataatttatcttttgcaagttttattacgaaatcctccgcttgtaaaaaatcggttaaatgattttaagatttcttcaaaataaacgtgaaaaaaatcccccaaaaagttaaataaatggtacatttgcaacgttttaattcattattattttaaccaacctacaggagtctttatgcttattggtgtaccaagagagctgttagacggtgaaactcgtgtggcagcaacgccaaaaaccgtagaacagattaagaaacttggttttgaagtcatcattgaagaaaatgctggctttaaagcaagttttgaagacgatgctttcgctcaagcaggtgcgactatcggcaacgcacaagccgtttggaatgcagacattatttttaaagtcaatgcaccaaccgatgccgaaattgcattaatcaaggaaggggcaacgcttgtgagctttatttggcctgctcaaaatcctgaattaatgcaaaaactttctgcaaagaaaatcaatgtgttagctatggacgctgtgccgcgtatttctcgtgcgcaagccctagatgctttaagttctatggcgaacattgctggttatcgtgccgttgttgaagccgctcacgaatttggtagcttctttacaggtcaaattaccgccgcaggtaaagtgccacctgcgaaagtacttgtgatcggtgcaggcgttgcaggtttagccgcaattggtgcagcaaacagccttggtgccatcgtgcgtgcgttcgactctcgtcctgaagtaaaagaacaagtacaatcaatgggtgcaagtttccttgaaattgattttaaagaggaaggtggcagcggtgatggctatgcaaaagtgatgtcggaagaatttaaccgccgtgcattagcactctatgctgaacaagcaaaagaagtggatattattattaccaccgcacttatcccaggcaaaccagccccacgcttaattaccaaagagatggttgccacaatgaaaccaggttcggtgattgtggatttagcggctgcaacgggcggtaactgcgaattaacccaagcaggtaaagtggttaccacagaaaaccaagtaaaaattatcggttatactgatttaccaggtcgtttaccaactcaatcatctcaactttacggcaccaacttagtcaatctcttgaaattactctgcaaagagaaagatggcaacatcaatatcaattttgaagatgtagtattgcgtggcgttaccgtaatccgtgatggcgaagtcacttggccggcaccaccaattcaagtatctgcacaaccgcaacaaaaagcagcggcaaaacctgctgagaaaaaagaagaaaaaccggcagatcctcgcattaaatatggcttgttagccttagcggtgatcgcattcttgtggttatcctctgttgcaccagcggcattcttatctcacttcaccgtcttcgttctctcttgcgtagtgggttactatgtagtttggaacgtcagccacgcattacatacgccattaatggcagtaactaatgcaatttcaggtattatcattgtcggtgcgttactacaaatctcacaaggtagcttctttatcagtgcgcttgcctttattgcgattttagtggcgagtatcaacatctttggtggcttcaaagttacccaaagaatgttagcaatgtttagaaaaggttaaggagaaagagtatgtctttaggtttagtacaagcggcatatattgtcgcagccgttctctttattatgagccttgcagggctttctaaacacgaaacggcaaaagcaggttgttggtacggcattgtgggtatgaccattgcccttatcgcaaccatctttggaccacaatcacaaggaaccatttggattttaatcgcaatggcaatcggtggtgctatcggtattcgtcaagcattaaaagttgaaatgaccgaaatgcctgagcttgtggcaattcttcacagcttcgtaggtttagcggcagtattagtcggctttaacagctacggtcttgcacacgaaacagatccagtgctacaaaatatccacaatgttgaggtattccttggtatcttcatcggtgcggtcactttcacaggttcagtggttgctttcggtaaattacgcggcattatcaattcaaaagcattaatgttgccacaccgccacaaattaaaccttgcggcacttgtggtttctgcattattaatggttgctttcttaaataacccagaaaatattttccctgtgttagtgatgactgcaattgctctagccttcggttggcacttggtggcttctatcggtggtgcggatatgccagtggttgtgtctatgcttaactcttattcaggttgggcggcggcagcggcaggctttatgttgagtaacgacttgcttatcgtcacaggggcattggtcggttcttcaggtgcaatcctttcttacattatgtgtaaagcaatgaaccgctcattcatcagcgttatcgcaggtggctttggtaacgatgttcaagtcagctcagatgaagaacaaggtgaacaccgtgaaactaccgcagaagaagtggcagaattacttaaaaatgcaagctctgtgatcatcacgccaggatacggtatggcagtggcacaagcacaatatcctgttgctgaaatcacacagaaattacgcgaccgtggcgtcaatgttcgctttggtattcacccggttgcaggacgtttaccaggtcatatgaacgtattgcttgctgaagcgaaagtgccttacgatgtagtattagaaatggacgaaatcaatgatgattttgcagatactgacgtagtcttggttatcggtgcaaacgacacagtaaacccagcggcaatggacgatccaaacagcccgattgcaggtatgccagtacttgaagtttggaaagcacaaaatgttatcgtgttcaaacgctcaatggcagtaggttatgccggcgtacaaaatccactattctttaaagaaaatacccaaatgttatttggtgatgcaaaagaacgtgtggacgacattttaaaagccttataagtagcaaaaaaataaccgcaacttataacaataaggtgcggttatttctacctatatttatgttcaaaaacaagcaattcttgcttctctctatgtttggcatcccctaaagtacacaagtaacatcgaaagaggcagtataatttcttggactttaggatcaaccgtacctaatcaaatacattctcaattagagaatgttcgaccatttcctgtcttagggtagacatgatttttatatactaaagaataaaataatcgaatatttaacgattcttatcagattttttgttaggatagcacctgaattttttatttctttttgagtgattactaagggatttttatgaacccaagacgcaaatctagattgaaagtggtgatggcagtgttaagtgggcttgctgttgctgttggtttaaccttatatgcgttaagccaaaacattgacttattctatacgccatcagagattatctatggtaaaaataatgacccggaaaccaagcctgaagttgggcaacgtattcgtgtagggggtatggtggttgatgggtcggtaaaacgtgatgataagacccttaaagtgacctttgatctcaatgatattgggcctgcaattcaggtggaatatgaagggattttgcctgacttattccgtgaagggcaagggattgtggcacaaggtactttagttgagccgacaaaactgaaagcaaccgaagtgttagctaaacacgatgaaaactatatgccacctgaattaggcgatcagatgaaaaagcaacatcagccgatggggatttcagaagcagatctcaaaggaaaatcagaacgtgatgcaacgcagatctctcagccgtttggagaaaataaatgattgctgaattaggtaactatacccttgctcttgctctcgcattggcaattttattggcgatcttaccgcttgttggcgctcataaacaaaatgctagtctgatggcattggctcgtccgatgacgtgggcggtttttttagcattatcaatctcgtttggctcgcttttttatctgtttgcggtcaatgattttactgtgcagtatgtggtgaataactcaaacagtacgttaccgttagagtatcgcctttccgctgtttggggttctcacgaaggatctttgttgctttggatttggctactttccctttggagcgttgccgttgcgacattcagccgacaaatgcctgaagaagccatcgctcgtgtattgggggtaatgggcttggttagcattggctttttagtctttattctgtttacttctaacccgtttaaccgaactttccctgattttcctgttgatggtcgagagcttaatccgatgttgcaagatgttggcttaatcttccaccctccgttactgtatatgggctatgtgggcttttctgttgcctttgcttttgctattgcgtcgttgatgacaggtcgtcttgatactgcttgggcgagatggtcacgtccttggactatggcagcgtgggtatttttgacattaggtatcgtacttggctcttggtgggcatattacgagcttggctggggcggttggtggttctgggatcctgtggaaaatgcctcgttaatgccgtggattgcaggtactgcattaattcactctttagcggtcacggaaaaacgtagtacattcaaagcgtggacggtcttgctagctattcttgctttttcactctgcttactcggcacattcttagtgcgttcagggattttggtatcggttcacgcttttgcttctgatccaactcggggcttatatattttggcttatctcgtggtggttattggcggttcgctactgctttacgcttatcaaggcagtaaaatcaagagcttagacaattccgaacgttactcacgagagtcaatgttattactcaataatgtgctattaatggcgttcttatcggtggtctttttaggcacgattttaccgttaattcataaacaaattggtttagggacaatttctatcggagcgcctttcttcgatcagatgtttatgatcttaatggtgccttttgcatttttattggggattggaccgcttgtaaaatggcgtcgagatcaggtttctgctatccgtaagccagtcctcatttcattagccgtaatggtattgcttggttttggcttaccttatctttttgccagcaaaattactgtcagcgtggtattagggacaatgatgtccgtcattatcgtggcattgagtttgtatgaactacatcaacgagcaacgcatcgtcatagtttcttgcaaggcattttgaaactttctcgttcccattggggaatggtgttggctcatttaggggttgcaatgactgtgtttggtattgcctttagccaaaattacagtatcgaaaaagatgtacgaatgaatgtaggcgacaaagttgaaattttagattacaactttaccttcaagggtattcgtgactcaaatggggcaaactatattggtggcacagcggatattgaaattcatcgaaatggtaaatatgaagccacactacacgcagaaaaacgcttttacaatgtcagtaaaatgggtatgactgaagctgcgattgactggggatttagtcgagatctctatgcagccttaggtgaacgtttagaagatggctcttggggcgtacgtttatactacaaaccgtttatccgttggatttggttcggtggtttgtttatggcgataggtggcatactttgtatgatggatagacgttatcgcttaaaacagaataattaactatgtttatcgctcttcataaggaataatcggcatggtagacaaaatagttgctaatgtttattttctctaaatattagcaactatttttatttgaaaaatcttgtatagacaacatattacaccttttatttacgaagtaatttataaaacagagtaagtaagactgttggcaataatctcggtaccactcgcatagtaaaagtgataaaacctgaaacgatattctgcatacccacttggtgttttaatttaaacaagcgccattctgccttagcctgagcgataccacgacggcgaccaaccataccatttccaacacgagcataaaccaaaacctcaggcaaattcgctacttttttgcctaatgcgaccaatttaatccagagataataatcttcttgtaagtcttgatagccaccacattcaagcacagcatttttttggtaggcgaccgtcatatgattaaatgggcaacgtttctgtgtaaactctacaatggctttggtttctgttggcacacgacgatagctgacaatatcattaatatctgagccaaattcagcaatttgtccgccaaaaataatggtatcgggattttgttcaataaacgcaatctgtttttcaaaacgttctggaatacaaatatcgtccgtatccatacggaatacccattcatttctgcagtgggttaagccgtgattgagtgcttttcctaacccttgattttgctctagtctaacgatattaagcggtaagatgtccgcaaaattttgcacaacttgctctaattcaggggtaatggctccgtcaaatacaacaacaatttcgtccgcttgaaccgtttgattttttaaactttcaaaacattcggttaaatattttgatttttccttaaaatataaggacattaatacggaaaacttcattaaataaaccttttcatattgattgcaagttttggtgaaataaatgtgagggtagcaatcaccaaatgtttaatatttttactttgtaggaacatctgccaataataacaagccgctttacgagataaattcattatatgtgggtaagaaagcatatataatgcattaaaagcaaagtttttttgttgaatatctgtttttacatatttttgtttaatagtttcaatcgctaattcagtattttgtgtatttgtcgatacacttgctcgtttagtatggaaagtacaggttgttaaggcttgagaaacatgttttggtttaaattcgttatgcgaaatgactttcaaaataaaatcatagtcttctagagattttaaatccgttgataatccattgactgcaaagaaaaatgattttttaatcgcaatcatcggcattccacctactttatttgccagtaaaatattctctaaagtgaccgcttgttcattttcataggggcgagtgatataactaaacccttcatttaccatcacacattcagcagggtgataaataaaattaatcgtcgggttttcattaattgtttttgccagtatttcacattttggatgagcaaaacgatcatcatcatctaaaaagagtagccactcgttttcagcaaatcttgctcctacattacgactttctgctgctcctaaattctgttcattcctaatcacattggcaggaaatgggtagagatgtttaatttctactggctcaacagagtgatcatcgacaataatcacttcaaaattatattccgtttgatattccaaacttgttaataatgcaggaatttcattttttcgattataagaaggaataataatactaaacattttctgtcttgttatttaaaaatagaattttatttttaccttcattgccaaataaagataaaaacattaataacactaacataatgccagggaaagcataggcatcggcttttacatttaaaatggagagaataagtaaggtagataagataaaaatccaactaccgtcaaaccaatttattgccacttttcgtacgaagtaacacataaataagaagcaaacagagagataaataaatccgccatataatgtttggcgtaaaaaaccagagtctgttctgccgtagtagccaccttgaggataaaaataacgtccatcaccaattaaaatctgttttaattcagggatataaagatgattttgaactagattatccgtagatgaactaactaaaccatagccgtgaataacattgattaaaggctctaaagcgtgttgtacatatttattttctgcaaaattaaaggctaaaaataaacagatagctccaaagagcaaaatggctggtatatatttccatctaaaatagacaagaaaactaattgcagaaataaataaaaaagtacgtcctgaaattaaaccaatacataataataagaagacaaatatcggactgatattattatattttgcattataagcaagtaaaaaatgcaataagaaagcatagaataaactaagctggaagaatacagtagaagttaaattatataaacggtattcttgttctgaaccatagaatttagggaaaaccgcattcgttgaaatacctaaatcaatcataaagggaatacctgccagtgcggtaaaacccactactgcttgaacaataataccgatttttaaatccctaaccatcatttcttttgcattagttttttgataatagcagagattataaatggcaacgccacaggtaaataaaattaagcctttaatatacattcctacggcataaaattctttagtgccgtgagataacatcggaataaccgctacaataattaggataaaaattgcgacaaaactatccagtggtaatgtaattccttgtaaacgttgtttgcggtagatttggtaaagcaaatataacatcgctattccaccacagaaaaatgccattcggaaaaaatggaataaccacggatcgtaaatataaaatagattaatgaatgctgacattttattttcctaaattacgttttattgccagtaattttttcagtgggtattttgctaattttgccccaaagctgtgtgaaatagatccacgaatactttctaaattactatttaattttgggttttcaatcaccattaatggacgaaccactttaatatctaaattaaaggtgttgccaaacaaaataaaatcatctgctagccaaaatggtaggttttgttctatctgttttaaaaaagtgcgagtcgctgattttttaattagatatgctactgttcctgcaaaataatttttataaggataaacaaccgcaaaaggacaagcggtaatttttggctgtaaaaatgcaaaggttgttggataattaatttctaattcaacatcattaaatgtcgcaattttagattgccccactaaaataatatctgcggacggctgtttatttaaaatacggttcaaatttgcctgaaaatcctgattaaacagtgcatcatcttcgcaaactaaactatattcatcatcaccaatcgtttcatcatcacaaatttgctgataaacaccaagatggcttaatgtacaaccaacttcgcctttcgtcactttacgagcgtaatgttgctcaaaatgagcgagattaaaacgtgaagataaactttgttcatcttcattcatcgtattaaaggcagaaaaaacgctaaaatcagcgctatcttgctgtgaaaaaaacagttcccgtctatgactatctttatctaaagagattaaatattttttcattttattctcgaatatcaataatggttacgcctaatttttcaaagagttggtaaacttgaataaagtctggattttcgacattaattcttaatgcaaccacatcaatatttgggattttgtcttttatatttaataccgcactactaaaataagtatatatacgacatcttttatgtttaaattcctgaactaaatagtcttctaaaattagtggcgtttcaatatattttacttgatttaatttatattgttctcttgggtgtggtaaataagcgtgaatatcaaaccacttgatgaccttttccgctaattcaatatttttctgtttatctaaataaacgggctgacctaataaaatatttatggtttcaccttctgctacatcactttctgtttgcggaaagagttccagatattcagtattttgaataatgttcggcaaatcagcataaatcgtaaaatgttttttggataacgcctttaattttgccacgctgtatttattgcagagtaacgtattaataaaacggcgaatacgagtttttggctcatcgacataatacacactatggcttacaatatttgctgtgccatcatcaaatgtataaaactcattaaattgaatgctgcttagaataaactgaatttgaatgtcattaatgcttgcgacaaatactttatcaaacttcttaaatgcaaatttaagacgcaaactaataatctcttttaatagattaaaacgatcaatatgttgatccatctgaaagaaagtatcacattttttcgctaaacgttgcacataatattcaaatttctgattttttgccgagcagagcatcacaccataaaatttttcatttggataaagattaataattcgctctgcaatcaaaacctgcaaaggcgtatagcaaatgatcaaattcatacggttttccccactttagatgtcataaaataaagtatcaggatcatcacagctgaaccaataatacttgcataaggtacaaattcaatagaagtaaaggttaatccgattaaactcaaaatatatattaccgttgaagccactgaacagattgagattaatttattcttactgtgataaaacaggtaattcactaaaataaaataaggaataacaagcgcggtcgaaaataagaataaaataatatagtattttgttccaacaaattgaacccctaataaccaaactataaattgctcaggaataacccacataattaatgaaggtaacggaacaatggctaaggaataaaatgcccatttttgcgtttgttttaaattaattcgaccttgttttaatccatcaaaaaaatagggagtgagtgctttatttactgcttgtaaaataatcatcaatatcgcagcaatttgagcccccatcgcatataaacctaaatcaacttgattaaattgatgataaataaatacacgatctaactgcccttttaagaaaaaactcacattatgcaaaattaatggcgtaccaaaagcaagcacataaaagagtgctgatttatattgcttccattgatattttttacttaccgtctttttgctataaactagatatgccaataaaaataccagtacattgcctaataaaatcccaagtaaccttttttcgaccaattctgtttgataaagttcgagaagtaataccgtaaaaacaacagtgcctaagctagaagcaaattgcaaaatggcataggaaatcgcctgtttttgacactgtcgaatgctcagctgaacacctaataaggcttgaaaaatagcagacaaggcaacataggtaagaatttctgattgtaaaatccagcaacccagtaaaattaagctacctatcgcaagggtataagcatagccagaagtcacgactaagttaagggagcgtttaccataaacatagaagtaacgggttaccgccccttcttgacttaaaccgacaataataaagaaaagcacaagataagtttggtaatatgcaagttccccaaacccttctacgcctaattttcgagataaatagggcaatagcaaaaatggcattgcccgtgaagtcagttcaccgattaaataaactgcactgtctttgatggctctcattgcatctctttctcaatcaagctatccgccagttgcaaatctaatgtggtatcaatatcgactgagcgataggttggcattaaatagaaacgcacaggtggaataaaaaagtatttttcttgaagtaggctggcgatatcgttgatataaatcgccccattcgcacggtatgcttttggtaattgctgacgtggtgcttcaaaatctttgatttcattcatcgggagaatatcatctccatttaaaacaaatgatttatacgggtggtgttcacattcacaagcggataccacagacttactttttccacctaaaaagatttccatcgcattgcgaatatctaacgcattgcgaagtgggctagttggttggaaatgagcgacaacgccttcacgaatgtttaaggtttctaaacagtgcaaaataacatcaatagtgcgagtatcactttgagccaattcagcagggcgaagtagtggtgttgcaccatatttttcaccttcctgtaaaatacgttcgccgtctgaagtgacaacgattaagtcaaacattccagactcttttgctgctagaactgcacggcctacgagcgaaattccgccgactaattgtaagtttttatctttaatccctttcgagcctgctctggctggaataattgcaatttttttcataaatctaaccgctagtaatatggttaataagacttgccattttaattttaaagagcgagttaaacaatagacaacggaaaaggaatgaggaataataaatctcttttacttacttgacaaaattgcctactcattatgtttgctatcacaaaatttattactgcggtcattcttccaccatttaacattctgattttatggttgttttctttaatttgtttccgcttaaaatggaaaaaattaggttatctctcaacttttttaggtgtagcaatgctctatattttcagtattccctatacttcacaaaaattgcacgattctttggtaactgaagataatctgagcattgaagattataaatcagctcaagctatcgttttacttgggggtggcttacgcgatagtaaagagctatttggcaaattagcgatcagcgaaatagcattagagcgggtacgttatgctgcttttttacaaaaagaaacgggcttacctttattaattacgggaagtagcccaaaagggacttcagaagctgccgtcatgaaaaaagagctcgaacaatttttccatattccaacacaatggttggaagaaaaagccaaaacgacggctgaaaatgcgaagttttctaaaccgattttagaaaaagaaggtattaataagattgtgctagtgacaaaccagtggcatatgcaacgagcaagaatgctatttgagcgagaaggttttaagatattacctgcaagtgttggagcaggaaaaatgcctgaaacctatggattaaatgtattttactttatcccacaatcaggagcattacatagcaatatgcacgccctgaaagaatggattggatattggaaagagaaataacggatattattaggttaatacatttagtagatcagccctagtgtaaaaacaaatatcactaaaaattcaaataggccgacttgtttaattttccagtttctttttggcacaataaccgctctaattaacccaatgaaataggcaaagctaatgccataatcgcctaaggcgagataaacaaagataaatatacaatgaagtcctatactgaacttacagtaaagaggatttttccgctctcgagcaacgctttttacataaattgttgtcccaataaaaaataacgtagggtggagtaaaatctcaaaattatattggttcgttgctaaatagaaacttgccattccaattatgccgaaggttaaaatacctgcaatatcattgattaagtttcgttcatctttttgttttgcatagtaaatttggacccctgcaagcggcaggattgggattataaattgcaaaatagaaaaatgacttaagagtacgggaaatataaatatgccgctaaatacggcataaataatcatccagcgtttatatttttcattttgttttttgctaacgacggagaaaaaaggataggaaaagagataagtaaaaaaccagctaagcccaagccaaaaatgattcattacaaaatggctagcagaaataccataaataaatggtacaaatgccatcactaacgctccgtactgattagaaataatcggcttttctttaaatatcatgcttatttctctactattttgtcttggttcccatatccagttttaaatttgatactctactatattgatttactttacttgcagcttattccctacaaagattttattttgttttaaaccatttagctggctcaatttttcaggtgttgttttatacatgcgagcaatggaataaagtgtttcatctttctgaacaacgtgatatttcgcattgagatcaaccgttttttctgacgctttagacgattgtttttgcttagtttccgtcgttatttttgctttctctttagttttttccttaggcgaagtcaccgctgctttagcttttttatcttccttagagcgattttctaccttcttttcagctttcgatttcttggttaatttttcatcattaactgctatttgattttgctgttttggtaatctatttttatatgcaattaacccttgataaatcgcctttgcaatctgacggcgatacgcttttgtggctaaacgttgttcttccgttgcattagataaaaagcccgtttccactagaattgaaggaatatcaggggaacgtaatacgctaaggctggcgtgttgtggcgaactttttgctaattgcgtaacatttctcagtttgtctaagactgttttacctaactcatagcctgaacgttgtgcgtgagaaaactgcagatcaagcactgtctggttcaagtaacgttcattattatttgccaaaaccgaacctgccccacctaataattccgattgcttttcgtgatcttccaaccattttcctaattcatcatttgcacgacgattagataaaacccaaaccgaagccccctttagattatctgaacttggtgaagagtcagcgtgaattgacactagataatttgctttgtttttacgagcaatttcagttcgattaggtagttggataaaatagtcaccattgcgtgtcattactgccttgaaattaggatctgcatctaacaacgcctttaattctctagcaattgctaaagtcacctctttttctttgacccctaaatttttaccgatagcccctggatctttgcccccgtgtccagcatcaatggcaatggttaattttgcttgtgcggaaagagcaagaaataaactcattaccgtaaagcaaacataatgtcgtaatttctgcatagtattaccctaagcggtctgatattctaaataattttccaaaatctgttttgctaagtcgttttgaggcataagagctagatttcgccctgtttctgcatagtcaatttgaataataaagtccgcagatgggatcattccttcccctcgacttgcccattctagtaagcaaaccgtttgtggacggaagtagtccctaattcccataaattctaactcttcaggatcactcaaacgatataaatcaaaatgatataaagcataagggggaagttgatactcttccactaaagtataagttggactttttacattcccattatgcccaaaagcacgaacaatactccgagtgagcgtcgtttttccagcccctaattctccattcagataaatcacaatcgctttttcactatgattttctaaatagcgttgaagttgttgggcaaaacgctgaccaaaattgagcatttcttcttcagttgcaaaataaaatgattgcattattgttaatctaaattaataaaatggtgacgataaaacttcagctcttcgatagactctttaatatcatctaaagctaagtggctgtttttcttactaaattgtttaagcatttcaggcttccaacggctcgcaagctcttttaatgtactcacatctaaatggcgatagtggaagtagtccgccaaatctggcatatatttataaaggaaacgcttatcttgtgcaatactgttaccacaaatcggcgaagcccctttcggcacccatttctgcaggaaatctaatgtctgtaattcggcagcacgttcagttaatttactctgcttcacacgctcaaccaacccatttgcagtatgggttttcacacaccattcgctcattttatttaataattcatcgggttgatgtacggcaagcacaggaccttcagccaaaatattcagatctttatcggtgataatggtagcaatctcaataattcgctctttttcaggatcaagccctgtcatttcgagatcgatccaaattaaattttgtttgtcttgttggctcatctttttcaattaattatctaaaattccacaggatattatttattgtagcatttcatgcaccactttcataaacccatcagcagtagcataaacttcttctttgccttgagcttttaaaatcatatcggaaagctcacggaatgcggaatgtccgcctttacgcgttaagactaaatctgcctgatttttaacataatcaaaagcatcgcccacggcaactgctaatccacagacttcaaatgcgggtaagtccagtgtatcgtcgcctaaaaatgcagtttcttcggctgaaacccccgcttgttgcattaactcaaaacaggcatcccgcttagacattttgccaagttggaaaaggggaatgcctaaatctttgatgcgacggcgtaaaatcggggtgtcaccgcccgatagcactgcaacttgaatgccgcaagcaagaagcattttgatccctaaaccgtctttcacattgaagtattttaatgcttcgccattttcggtgtaataaaggctaccatcagtgagtacaccgtccacatcggtaatcacaagtttaatttttgtcagtctttgcataagtatccttgatttcagttaagtggagttttatgatcttgcccattatagccttttggagtagccaatgtcgatttctcaaaatttagcgataatttctcaacaaattcaacaatattgtcagcaagctaatcgccctgaacagagtgttaaactgcttgcggtgagcaaaactaaacccatttcagccattgccgaagccattgaagcagggcaacgtgctttcggcgaaaattatgtgcaagaaggtattgaaaaaattcaatattttgcggagaacgacacattagaatggcactttatcggtttattacaatcgaataaaacgcgtgtagtggcggagcattttgactgggtacaaacgatagataggctcaaaattgcacaacgtttaagcgaacaacgccctaaacacctgcctgtactgaatgttttaattcaaattaatatcagtgatgaagcatctaaatcgggtatttctgcgaaagaaatgctagaattagccactcaaattagccaactgccacgtttgaaattgcgtggtttaatggcaattccgaagcctgaaagtgagcctgaacaacagaaaatcgccttagctcaaatgaatgaactgtttcttcaattacaatctcaatttgaagggattgatacgctatcaatgggaatgtctgatgatatgccaagtgcaattgaatgcggttcgacaatggtgcgtattggtacggcgatttttggggcaagatcttaaatttgattgcacttaaagacaaatattcttatcctttccacatttgaaagttctaagggagaagctatgcgacctaaagcaaaatttagaaaagattaccgtcagcctgattttactattcatcaaatttatcttgatgttcagcttgatcctgagcagacgattgtcacatcgacgttgtcgatcatgcgtaagaatgcagaagcgactacgttacgtttagatgggcatagctttgaatttttatcgattaaatttaatggcgagccattcaaagaatatcaaaaagatgatgaggctttgactttaaatttagccgatttccctgcggatcaattcgagctggaaattcagacaaaactcaatccatcaacgaatacgtcactacaagggttatatcaatcaggcgaagggatctgcacgcaatgtgaagcggaaggtttccgtcagattacttatatgcttgatcgccctgatgtgcttgcaaaatatcgcaccaaaatcaccgcttgtaaaagtaaatatccatacctgctttctaacggcaaccgtattgctcaaggggagctggacgatggtcgtcactgggtggagtgggaagatccgttctttaaaccaagctatttatttgccttagtcgcaggggattttgacctgttacaagataagtttatcacgatgagcggacgtgaagttgcccttgaaatctatgtggataaaggaaatcttgaccgtgccacttgggcaatggagagtttaaaacgttcgatgaaatgggacgaagagcgttttgggctggagtacgatttagacatttatatgatcgtggcggtcgatttctttaatatgggggcaatggaaaataaggggttaaacatttttaactcgaaatttgtgctggctaatccgcaaactgcaacggacgatgattatttgaatgttgaagcggtgattgctcacgaatatttccataactggacgggcaaccgtattacttgccgtgactggttccaactcagtttaaaagaaggtttgaccgttttccgtgatcaagaatttacttcagatttatggtcaagatcggcaaaacggattgaagatgtgcgattgttgcgtgcggtgcaatttgccgaagatgcaagcccgatggctcaccctattcgccctgaaaaagtgattgaaatgaataatttctatacggttaccgtctatgaaaaaggggctgaagttattcgtatgatccacaccttactcggcgaagagcgtttccaaaaaggaatgaaactctatgtggcagaaaatgatggcacagcggcaacctgtgaagattttgtgtctgcaatggaacgtgcttcgggagttgatttagatctgttccgccgttggtatagccaatcgggtacacctgaattaacgatttcagatgagtatgatgagaaacgtcatacttaccgtttgcacgtttctcaaaacacaccaccaaccgccgatcagcttgagaaagtgaatttacacattccgttgaaagtagcgttatatggtcaagatggtaagaaaatcaagttacaacacgaattattaactgtcagtgatgtgttagatgtggtccacgaacatcaaacctttgagttccacaatgtgcaacaacgtccagtgcctgccttgttatgtgatttctcagcccctgtgcgtttagattatgattattcgacagaacagcttttgacgctcttgaaatttgctgagaatgattttgtgcgttgggacgtggcacaaatgttgtttaacaatgagctgcgtgaaaatctaagtcgctaccaacagggcgaagcaatggcattctcacaaggtttgttagaagcgctcacctttgttatcgacaatgcaaataaagacccagaactcgccgctttaaccttaaccttgccaaaagaaacggaatttgcagagttgtttaaagtgatcgatcctgcaggtattgcggctgttcgtcaatttatgcaacaagcgattgctgatgaattaaaagatcacttcttagtcgtttacaaccaaaataaattaacggaataccgtgtggttgccgaggatttggcaaaacgggcattacgcaatgtctgcttgtcttaccttgcctttaccgaagtgggtaataccttggtacacaaacattatcatcaagcaaacaatatgacggatactttggcggcactctcagcttcgaccaaagcacaacttgcctgtcgagatcagcttcttgccgattttgaacaaaaatggcaacacgatggcttagtgatggataaatggtttgctttacaggcgacacgtcctgatgaaaatgtgcttgaaattgtgcaaaatttattaacgcacccaagttttaacttcaaaaatccaaaccgtgtacgttcattagttggggcatttgcaagccaaaacccaagtgcattccacgctattgacggctctggctaccgtttcttagtcgatatgttgattaagatgaatgaaagcaatccgcaagtggcggcacgcttaattgagccgttaattaaactttctcgctatgacactcaacgtcaaaccctgatgcgtcgcggcttagagcgtttgaaaggtttagataatcttgcgcgtgatttgtttgaaaaaattgaaaaggcattgcagtaatgatctggcataaagcattattttcttttcacggaaggttaaaccgcaaaggcttttggatcggctttgggattaattttgcatttttgtttatttttgcaaattttatcttaaatccgaccgctttcagctggattagcgttctacccttgaccctttcactttacagtttatctgcagtgatcgttaaacgcctacacgaccgtaatcgttcggcgaaagccttgtttatggttgcggtgccgatattgtgttatctcagttcattgggagctcaaggaacaatggcatttgttctaggcattatgatgccgatgtttatcggaacgattttagtgatggaatggggtgtttttgcaggaagtcctgaagctaatcaatatggtgagaaaggattgagtgtgagatttaaataattgtagggtgggtcttgacccaccatttcgctgtaatctcttgaatttattggtgggttaaaacccaccctacaaaactgttttttaaatctcccccagcccctctttttcaaagaggggagtttacaaattttaataacaaacaaatacaaaatgaccgaaataaaacttaactaccacaaaacccattttttaacctctgcacctgatattcaccatttaccagaagacagtggcgtggaaattgcctttgcagggcgttcaaatgcagggaaatcaacggcattaaatgccttaactaatcaaaaaaacttggctcgtacctctaaaaccccagggcgtacgcagttaattaacttatttgaagtagaaccaaattgtaaattagtcgatttaccaggctatggttatgcggcggtgcctgagcagatgaaacttcagtggcaacgttctttaggtgaatacttgcagaaacgtgaatgtttacggggcgtagtgattttaatggatattcgccacccgttgaaagatctcgatcagcagatgatcgagtgggcggtatctgcggagttgcctgtattattgctacttaccaaagcggataaacttagccaaagtgcgagaagcaaaaccgtcaaaatggtgcgggaagcgattttaccgtttcaaggcgatgtgcaagtcgaagcctattctgcattaaatcgtattggtattgataaacttgcgactaaattagatagttggttcgccgaaatttttacacaaacccaagagggctaatcttatgtacaacttaaccgaattacgccaagaaaccgatgaaatcatcaaatctttattagacgatggcagcgatcctgaagccctttatattatcgaacaccacgttgctcaccacgatttcgataaactcgaaaagttagtggtagatgcttataagttgggctatgagatttctgaagcggaagaagtggaagaagagaatggcgatcttgtgtttgtgtgcgatattgtcagcgaaattaaactagatgcggaacttattaccgctcaacaaaaagagctactgccgttaatcgaaaaatcgggtgcggtctacgaaggctggggaacttattttgaagatccgaacagtgatgaagatgaatatggtgatgacggcgaatttttcgatgacgaagatgatgattttgatgatgaaagacgttaaccattagcagaattatgaaaataaatgataaccctatgtagaatatttaccatgtaagaatcaagtaataaggaggagcaatgctaacaaattggtcagaaggttatgttaatgatattaattatacgacaggttattacgatggattaaatagccaccaattaatttgtccattcttaatagcaaatttacagccgccaaaagtcattaatgcgtgtgagttaggttttgggtttggtgtatcgcttaatattcatgcagtagcaggaacagtaaaatggtacgggactgattttaatccttctcatgcgttctttgctcaacaattagcaaaccaaggcaatccagataaagtcgttattgcagatcaatcttttgccgaattttgtcatcgagatgacttacctgattttgattttattgctctacatggtatttggtcttggatttcaccacaaaatagagaaactatcgttgattttattcaacgtaaattaaaagtaggtggtgtagtctatattagctataacacattaccaggatgggcaggaaaatcaccaattagatatttattaaatcaatactatagtaaattatctgctactctagaatcaaaagatcaagcgattaaatcagcattagaacatacaaagaatatgctttcagtgagtaatagtctcctttctctctcaccttatttgttggaacaagttgaacagatcaaagaacaaaattctaattacgtcattcatgaatttactaatcagaattggtatccaatgtatttttcagaaattgaatcctgcttgaaacaagctaaattaagttacgcatgctccgtttcttatttagatgattttgatgaggttttatttgatgaagagcaacaaaaattattatctagcattcaagatccttctttatttcaaacagcaaaagactttattttaaataaacaattccgccgtgattattgggttaaaggaaaatctcaacttactaatcaacaaggagagaaagaatggaagaaattaaatatattacttgtttcatctacaacaaaaatttcgaccacgattaaaaactaccgacaaacggaatttaaagaagaattattaaaacctattattgaaaaattatctgattataagattcactcgttagaatctttgtgtgaagccttaaaaggggatatgcctccaaatgcattatttagaataattgccctattagtagctcgaaaagaagttgtcattactcaatcggctgaaacaatagaagcagctacaaattcctgccagaaatttaaccgagctatattggataatccttttgcttttaataacgttaactatctggcaagtcctgtgtcaggtggtgggatttattattctaatattgaattactctttttatctgcatatgtacagaaaattccagagaaacagtgggaaaaatatgtacgtactattttaacagcacataatcaactattacgtaaagatgataatattctatcttctgaagaagagatacttggagaaatatctcgtctgaagaaagaatttttagatgatagatttgaaattacaaaaagtttaaaggtggtctagcccctttttcacccaatattgatacggcttagtatctgtttgactttttaatagctgatgatccataaattgacaaaaactcggaatatcacgagtagttgcaggatcgtcagcaataattagcaacacttcaccatctgccatattgcgaatggttttgcgagtaagcattacaggttcaggacaacgtagccctagggtatctaaagtgtggttaatggttagttcggtcatcgttattattcaaaattaaaaattacaggatatatatgcaacagcttttctctcaacacatcgcacgtattcaacaaatcgtacagcacgccttagagctggctcgtcttgacgggctttggatttatgcagggcaggcaaaatatcattttttagacgaccaaacatcgccatttaaaatcaatccgcattttaattatattttccctgatcccaccgcagaacaaagttggctttttttagacggtaaaaataaaccgaaactctatttttatgcaccgcaagattattggcattgtacgccaaatccgccaacgttggcattttttgctgatgagtttgaatggcaaatgctcacggatagccaacaaattcgacaatatatccttaatccgacctattgtgcctttattggcgaacaaacggagttggcaaaatcactaggttttgagcatatcaatccacagaaagtgctaaatgtactgcattttgagcgttcgatcaaaagcgaatttgaaattgagtgcatttatcaagctcaactcactgctttagctggacaccaagcggcaaaagaggctttttttgcaggtaaaagtgagtttgaaattaatctagcctatcttcaagtgaccaagcaatcggataacaatgtgccttatggcaatattgttgccattaatcagcatagtgcgattttacattacacaaaattggatttcacgccgccttgtgaacgccacagttttttacttgacgctggtacaagctatcttggttatgcctccgatcttactcgaacttatgcttttgagccacaaagtgaatttgccacaatggttgctcaaatggaacagtttaaactggatacgattgctgatatgcaagtggggattaattatctaagttaccatacccaaatgcaccgttggatctcgcaaatgcttcaccagtttgagtttgtgaaattacctgccgatcaaatttttgaagagggtattagccgtaccttcttcccacacggtttagggcatcagcttggtttgcaagtccacgatgttgcaggcttccaacaaaaccaccgtggcacacgcaaagctccgcctgagatttatccaagtttgcgctgcactcgtgatttagccgaaggtatggtgcttaccattgaacctgggttctattttattgagatgttgctaaatcaatggaaaaaccacccgcttgctcgtttctttaactggcagaaaatcgacgaatttaaacgctacggcggtattcggacggaagataacattgtgatgagagcgacgggtgcagaaaacttaacggcaaaagctgaaagtatcagtagcagataagtaattattacagatcccatttagcttaaaatatctaaatgggaagttggtgtactcataaataatatttctaatctaaagaaaatagatctaataatgtggcaaagctttgcgatttcactatattgtgaaactcttcaatgtaaactttatctagatctgtttccctgattgctgcgtataaattgctatataagccattagaagtgatttttcttgcaacaacatagcctttttctaaatatggttttacagcccaataaggtaaggccgcaatacctcttttactggcaacaagctgaatgattgcgatagttaattcactagtgcgtcttgttgggtttattcctactggttgtaagatttttttcaataaatctaacatattgtcgggaacaggataatgaattagtgtttcgtgacgaaaatcttcagcttcccaaatttctttttgtgccaaagggtgatctttggcacaaatagcaaccatttcataagaaaataaaggtttataaataataccaatggactcttctatttctgatacaacagcccagtctgctcggtgagtaagcaatagaccaacagtatcagtatgaaaaccagacacaatatctaattctattcccccccaattttgtctaaaaatatccattgctggcattaaccaatcaaaacaagtgtggcattcaacagcaatccgtaattctccaacttctccttgtttaattcgggttatatctgattcagcttctattattttaggtaaaatttcataagcgagctgtactaaacgttctccagctggagtaaaatggattggctgagttttacgttcaaatagagttagatcatattgatcttctaacaatttaatttgatgagataatgctgattgtgttaaatgaatacatttggcggcagctgaaacactgccgctttcttttaaagcaataatagttcgtaaatgacgaagctctaagaaaattggtttcattagtctgaattttgaatgtaacaactacaattgacctagaatagcatgtatttactatattagaaaatcgttttcctaatcagcattactttattttttattagcatgctgggttaaatacatagtttctattatctatatcattttataaatggcaaatagccttctatttaaatattacttaaaatatgaaaaaaactatttacttccataaattagcaatattactttctctatttttttcaaatgaaccgattgttgctaaacatatagcacagaaaacatgtatagttgtaggtatttatgatggcgatactttaacctgcttgcacaagcggacacaacttaaagtacgcctgcaatatattgatgccccagaatttgcccagccttttggtaataaggcgaagcaatcgttaactcaactggcatttaaaaaagaggttgaacttgagattacggggtatgataaatatcaacggctgttggcagtggtttatgatcagaggggtgaaaatcttaacttaattcaggtgcaacgaggaatggcgtgggcgtatcgccaaacacaacctgtgtatctgcaagctcaacaacttgctcaacagcaaagaataggtttatggcaagataaaaatccgatcaatcctgcggactggcgtgcaagtaagcggtcagatgaacattcattttggcaaggtttttcgcctaaggcaccgcttgccactatagattgtaatgtgaggaaaagttgtaacgatcttcccgattatgacacggcgaaacgctactttaaacaatgccgttggcgagagctagacggcaataatgatggtatcccttgtaataaactttatagaaaggctcagcgacaatgattaatcacacttttcgttcccatttccctttttttcaagataatcccgatgcggtatatttagatactgccgcaacgacactcaaaccgaaagtgttgatggacgcaacgctcaatttttatcgttcatctggttcggttcaccgtagtcaatatgattttcctcaaacgcaacgttatgaattagcaagggatttagtggcaaaacgtttcaatgttacaacacgagatgcggttatctggacaagtggcacaacccattcacttaatttagtcgcaaatggtttagctgacagtattgaagctggtgatgaaattgtgatttctgtggcagaacatcacgctaattttattccgtggcaacaacttgctgagcgtaaacaagctagattgattgtgctaccgcttaatagcgactaccaaattgcccctgaaacgctacaaacagccttatcagaacgcactaaaatcgttgcgtttaatttggtgtcaaatgtaacagggattagacagcctgcagagcaattgataccgcttattcgtcagcaatgttcagccaaaattgtgcttgatgttgcacaagcggtctgttgtgaacaaattgatgtacaagcacttgatgccgatttttatgcgttttctgcacataagatgtacggaccaaccggggttggcgtattaacagggaaattgagtagccttgagcaactccgccctcttttatttggcggaaaaatgttacaagagattactgagcaaaagctcacgatggcaacattgccttatcgtttagaagcaggaacaccaaatatcgcaggaattatcgcttttggtgaggtgctggagtggttggaaaaatgggatttttcagccttaaactcaccgctttatcagcttgctaaagaggctcgccaacggttagcagcttatccaaatatacgcattttagcggaaggaagtttaagcccaacgattagctttgtctttcatcatcaacatcacgcagatattgcggcgattttagccgagcaacagatcgcattgcgtagtggtgaacattgtgccaaaccctacttacgttatttagcacaaaatggcaccttgagaatatctcttgctcattacaatgtgcaagcggatcttgaccgctttttgaccgcattagattttgctctcgacattttagaaaattaatctcaacttagatcaaaaaatcgtaaatttcccgattttctgctagaacgaaagggcgttatagggtaatctttgcaagttttttgatttattttttaaaattaaatttataggtattgatatggtaaaaaaaattgcagtattaaccagtggcggtgatgctcctggtatgaatgcagcgatccgtggtgttgtgcgtgcgggtttaagtgaaggtttagaagtgtatggtattcaagacggttattacggtttatatcacgaccgtgttatcaaacttgaacgccgttcagtgtctgaagtgatcaaccgtggcggtacattcttaggttctgcacgtttccctgaatttaaaaatccagaagtgcgtgcaaaatgtgtagaaaccttgaaaaaatatgaaattgatgcgttagtagttatcggcggtgacggctcttatatgggggcaaaactattgaccgaagaacacggcattgcgtgtatcggtctacctggcactattgataatgacgttgcaggcacggattacactatcggtttccaaacagcacttgaaaccgcattagaagcaattgaccgcttgcgtgatacttcaacttctcaccaacgcatttctatcgttgaaattatggggcgccactgtggtgatttaaccttaagtgcggcattagcaggcggttgtgaatacattatcattccagaaaaaggttttgataaagagtcactaatacgcaacatcgaagatggtttcaataaaggaaaacgtcacgcaattattgcgattacagaattaatgacagatgtacaccaattagcgagagagattgaagaacgctttggccacgaaacccgtgctgctgtgttaggccatacccaacgtggtggtgcgccttgtgcatttgaccgtattttagcttctcgtatgggcgtttatgcagtagaactcttgatgcaaggctacggtggtcgttgtgtgggtattcaaaatgaaaaattagttcaccacgatattattgatgcaatcactaatatgcgtcgtccgtttaaagaagaaatctttaatacctctagaaaattattctaataaaaagtggcactaagccacttttttattatccgtatctttaaccaaatcactgaatgagtcggtgttctattcggctttatcccaaaatactaattgctttatttactcataggtaatttgtcaattttgtgctttaaggaaaggcaatagcaataatgcgatgccagaggctgcacaagcaatcacgacaaaaaatccagaccagtggtgtgattccatcactaatgctaaaggataaccagctatagcagcacctaaatatgcaaataatcccacaaaccctgttgctgaagctggagtttttttatgggaacattcagcagctgccataccaataagcatttgaggaccaaatacgaaaaaacctactgaaaagaaaattcctgcttgtaatatgaaattttcttttggcataagccacattgcaataatggagaaaaaaataccaatagcaaataacaatgccattggaccacgattgctagcgaataatttatctgatccccaaccagcaactagagatcctataaatcctcctacttcaaagagtgaaagtgcgctattagcagaaacaagatcatagtgatatttttcagttaaatagatatttccccaatcgttaatggcagttctaaccacataaacaagagcataacttaatgctaatagccaaatgtatttattaaaaaaaacatattgatgtaagatcttattccatgtgagatatttaccttctttctcttgagcaagctctaagttatcattgcgccattttcctatgctaggtaatcccatggtttctggagtattctgtaatcgaaaaaataggaatatactgattaatattgctaagcctccagcggcgataaatccatatctccaactataatgtaaggtgagataaccaataattaatgggatcatcgctccaccaacattgtgcgcagtattccaaatagaccaccataagcctctttcatttcttgaataccaagttgttagtaacttagaacaagagggccatccccatccttgaaaccaagcattaataacccacaatatagtaaacatgagaacagagctagataggccaaataatatatttgtgattcctgtaagaaataatccataagccataaaatgtttaggattttctttatctaggtaaacacctgaaataaattttgaaataccataggttatgtagaataatgttgagattatccctatattatttttatcaatgcctaaatcagtaattagagtaggaacgacataattaaagcttttccgagtcaaatagaagccggcataaccaatatacattcctatcataatatgtagtcgccagtagtgataaattttatgactttgattttccattatttttatacgtaaggtaaattaactataagtgttgttccatgttgaattggatttttttcaataggaatagagataatttcaaatgtaccacataaaatattcactctctcttgcattccacgaattccaaatcctgttaatatctgatatgtatcaaatccaaccccgttatctgtaataataatatgtatattattttttatttcaatttctatttttaccttatttgctttagcatattttataatgttattcaaactttcttgacataatctatatatagtaatttccagaatatgttctaattttaaattttgatcatttttccatattaattcagtatcaatttgattatcttgaaaatttagttcaataaatagattctcaatagcttggggtaaatctaaatcatcaagtagacgaggtcgaattcgatttagtagtacttttgttgtatcataaatattaagagataattgctctattgtggttgatattttttcataattaggtgcaatcctttttaaaatgtttgcttgagttctaatggctgtaatattttgcccgacctcatcgtgtaattctctagagatttcttgacgaatagtttcttcagtattaatcagctgccgagttagtaatctatttttatttaattctattgataaactttggttcaagttacgctgatcttgaatcgcaagtcctagaaatattcctgtgatagtttgggttgaaatagatagtaataaatcagctatagtgagattagaaaaactatgtgtagtaccaataagtgctatactattaagaaggactcctaaaaatgcaccttgccaaccatactgaaaagctaataatataatagggattgcaaggtagaataaagcaaacctatagaaggtatctggcaatttcatttgaatatagatatttaaaacaaatagtaaaatataaataaaaatgtgctttattcttaaagttaccggcttctttattagagaagaagtaagaggaagccattcagtcttaaataaaaactcattgattaaatagcaagcaggaacaatcaataccccaccagtaaaacttacaagaaatgtgaagtaaaattctgatgaggaaatggctacagcattgatcatactaattgaaactatagtgctaagttgaattgataattttttccattgatttccactatagtataaatatgataagtaaataattgggatactacatatacttaaaataaaaatagaatattgatatatttctggaaataaatagtttaataaaatcaatatactaatttcagaacaatatacaataggccagaatttaggttgaatatgcaatataataccactacgtaaggcaaacggcaaaaatagacaggccaaaacaatatctgaaagtaaataatctgagattatccataagcagaaataagaacaaattatcaaaaaccaagagtataatatagtaaatatcattttagttgtgaatttaataaattcgctaattcaacattatttttgacattgagtttatttattgcattagatctatgaacatgtactgtcttaaaactcaaattaagtttttcgcctatttcctttggttcaaaacctaagattaataactcacaaatttccctttctctttttgttaattgccctaccagattagactgtttagatgaaactaattttgtggttagttctggcattagatatacacctcctgagcatactgttttaaccgcttgaattaactcatcaggattacatcgtttgcttaaatacccttttgctcctaattctaacgctttttttataattaaatctgagtcatttacacttagcataatacagtggatacctgacggtatatcttttaataaatctaagccactttcatctggtattgaaatatcaataatacatacatgaggttttaaataaggtaaatgttgacgagcttctttagcagaagaaaattctccaataacagtaacgtcactctctaaagaaaggagttgagaaaaaccagagcgtacaatgacatgatcatcaataagaacaacatgaatcataaaatccttccaattaataatagcgtatttctataaaaaatacggtggaaaagtccaccgtattcttgttactcaacatattctatcttttacgaatttttttctcttctgcgattgcaacgaaggctaacaatccaatacaagtaattgctgatgcatgaagtgctgcaaaagtaccactccatccggttagaccaaaaattggagtaccgtcagcaatcattcctaatcctagttttgcaaaactatctccaattaagtaagcaaaggtaccttttacaccatcagaaacagcaattgcttttttaggaacaaacccaacagcagccacgccaatcagtaattgaggaccaaatactaaaaagcctaaagcaaacaatgccgttaaatacataaattcattagttgcaaactgatagaactcaagagtaaaaacaatcagacctagggcgatacaagcggttaaggcacgacgaccatttgctaaatcagataaatatccccataagaatgtacccactaatgccccgacttcaaatagagcaaaaccggaaatagcagcatcttttgaaaatcctaattcttgataggcatatactggggaccactgatcaataccaatacgaacaatatatagaaaaatgttagcaaagcatagtagccaaataactttatttcttaatacatattgaacaaatatctgccatttggtcagttgattttcttcagtattacgatcttcctcactaatttcctccccaaataattcttccgctttacctaaaccatatgcctcaggagaatcagaaccatagcgtaatcctataaatccaataattaatgcaataattgatggaaatacaaacattccaatgacatgtccattaaagaagacattagctccgaataatgcaactccagcagctgccgcaccacctacattgtgtgataaattccagaaacccaaaaatgttcctcgtttctttctaggcgtccatttagtaattgtggagtagctagatgatccccctgtactttggaaaaagccactaagtgcatagaatgaaatcattaagaacagtgcaatgctccctcctcccatactagcactaaagccaagcatacagatagctgaaagaataagcataaatggtacaaattgttttgtatttttaccatcagcataataagagactacggttttcccaataccataagtaattgaaaaacctaagccaataaggcctaaatctgttttagttaaaccgtaagtttcgatcatatcattttgtgcgatgttgaaattcttacgaatcaagtacattgccatataaccgataaatacaactaaataagattgcataaaaggtttgaaccacattttccgtctttcttctagggatagatctaagactgggcgtctaacttcagctaaaaatgaaaacataatttcctctgatatttttaaaaagatatttaaattttaagaaaattatttcattgctccttgagagaatcccctaaatagaataagaaaatttcctagtttagataccgttaactgtattttgtgactaagatcacattttagggtttattgtgaatttctaggaacaataacggacagatggtttttcccttcaaccttggatatttctgctataaccgcaggagaaaaatgtactctctgctgtgttagttgatagactaagtcaaagacaaggggcaagtgagagataatcagcacatgcttcgctccctcttctcgtagaaatgcaagataatcaatcactgtgtcgggatttccgtcaggggtaatctcttcccatgtttccgcaagatttgcaaaactttgcatagtgttgaccgcttgcataccttgttttacggcttgtgccgtttgctgtgtgcgaaggtaggggctaataatcactttatctaatttaatttgttgattttcaagcctttttgcaagccattgcccttgttgatatgccatcaatttaccctgttcagttaagtttctctgtgcatcagttggggcattgaaacctgcttcgccgtgtcgcattatccaaatattcatcggtttatcctcttcgtggtttaaacagaacacttttaggcgtataatgcacggcgttttttgttgttgcaagcaacagataaaagatttctatttttcacaatttaaacaatggagtaattgaataatgtctcgtaaactcagaagaaccaaaatcgtttgtacaatgggtccagctacagatcgtggcaatacgttagaaaaaatcattgctgctggtgcaaatatggttcgtatgaacttttctcacggtgtgcctgaagatcatatctctcgtgcagaaaaagtgcgtgaaattgcaaaacgtttaggcaaacacgttgcgattttaggtgacttacaaggccctaaaatccgtgtttctaccttcaaagaaggcaaaattttcttaaacatcggtgataaatttaccttagatgcagaattaccaaaaggcgaaggtcatcaagaagcggttggtttagactataaaaacctaccaaacgatgtcgttccaggcgatattcttttattagatgatggtaacgttcaattaaaagtgctttctattgacggcgctaaagtatttactgaagttatcgtgggcggtccattatcaaacaacaaaggtatcaacaaattaggtggcggtttatctgctccagcattaacggacaaagataaagaagatattaaacttgcagcgaaaattggcgtggattacctagcggtatctttcccacaatcaagtgcagatttgaactatgctcgtcaattagcaaaagaagcaggattagacactaaaattgtcgctaaagtagaacgtgctgaaaccgttgcaactgaagaagcaatgaacgacatcattttaggtgcagacgttattatggtggctcgtggtgacttaggtgttgaaatcggtgacgcagcattagttggcgttcagaaaaaacttatccgtcgttcacgcaaattgaaccgtgttgtaattaccgcaacgcaaatgatggaatcaatgatcaaaaaaccaatgccaacccgtgcagaagttatggacgtagcaaacgcagtattagatggcactgacgcggtaatgctttcaggtgaaacggcaaacggcgactacccagttgaaacagtaaaatcaatggcggaagtctgtttaggtgctgaaacaatgccaagcatcaatgtttcacgtcaccgtatggaaggtaaatttgaaaatgtagatgaagctgtggcaatgtctgcaatgtacactgcaaaccacttagaaggcgtttctgcaattatcgcattaaccaactcaggtgaaaccgcaaaattaatgagccgtatcagctcaggcttaccaatctatgccctttctcgtaacgaacaagcgttaaatcgttgtgcgttataccgtggtgtaaccccagttcattacgatcaagacagccgtactattgaaggtgcgaaaaaagcaatcgctctactgaaagaacaaggctacttaatgaccggagatttagtgctactaactcatggtgatgagttaaaagaaggtggtacaaatacttgccgcatcttacgcgtagaataatctactaagtcgataaaaatccacgcaaatgcgtggatttttttattctctcaaatttaatctaacgaatttcgcctactgagactttggcatcggtatgtttattgccaataattcgatcttcacatttattgttttcatcacaaatagagacaacaacactcttctcatcttctagtgcttcagattgtagagatttaactcccgacttattattttcaactaaattactctgttcgcgagatagataagttggcttgagtccgttaagtttatctaatatcgtatttaattgacgctcattaagtcttttgatattcccatctccagccaactcatcatcaccatagtttgtttctctcggttgctcataaaatgtaaaatcagtattttttagcacgataggcatatctttatggctgtaataggctttagcgccatttggagctagtgcgataaccgttgcattctcaatcgttgtctttgtagcatcacctagtgctaaagcaaagttagctgcattcgcatcattatcagcagagcctgtaataccaatttcaggtgcaggtttaggtccagtatttaacaaagtaatcgttaaatcattttttgatttttcaccgcgtaatgttgcatttttatctgtcatcaacgtataaccttgatggcttttcaggttaatcgaactgctatttcgcccttctaaatccccaacaacatacattgttgccgctttcatttttgaactcggtgaaacattcagtttttcagccccctgaatatttaatgatgtgtgatctaaaatcgttttatctgcacttaacccaattttatggatacgatcgtaatcagattcaaaagacatatttcgatcaaaagtaacattaaattggctgtcggttaaattaatattttttgccataagattaataaaaccatcattcgtttttatattactattacgaatattaattgtcgtttctaaatggcttttaggtgttttaataacttcttgtttaattttgtcataactattatttgtagctgtccaccaatcaaatgcatataggaactcattattaatccattgacgtaaattattattgaatttccatcgtctttgagtatgatttctttctgtacgcaacgctctatctttggtattgaaaatcgcatagtcatagcttggtttttctttattataggaatatcccccataaatatagaaattacctcttcctatatgagtaagacgatcaatatctacattattaaagccaccaacaatgacaaaatcatctactttatcaagctgcaaattactaatatttacgctaaaaggcgatctttgagtatcttctaaacaataggcaagattaatacaagttctagaatcttctaaatttcttcttaaaccatttctgcccaatacaatagcgccattattgaaattaaatttactatctataatctgaatatctgaaatgcctttatccgcaaaatttttatccattaaatctgtcgcaataaataaacgcccatttttagtatctatatttgctttattaaaacgaatatagctaggattagtataatttaattgtgtatttaataataaaactgaatcagtatctttatatgaatctatatttatatcacctgaaatatcaaaattatgtgcatttagatttacttctcctgaaataccaagtaaagaacctaaaaaattactgcttacaaaagaattctcacctacttttttatttccaatatcaagattatcggctaatttcagattaacttttgtctttaattttttagaaccatcatcataatagtttttatcttctcgaattaaatcgccactcagattaactttttttatagctggttcaaaataactactagttgaaaaatcaatgctatctttaacagtaagttttgcgcctttttcagcatttaagttaatttcattctttttcgcttttatttctaaactttcggcttgaatatcactattttttccaaattggatatcatcagaaaataaggttatttttccagagcgagacattacaacattatcagcctgtaataatccatcattattaacaaggttattaattaactcactttttcccttagcagttagctcaatataaccatcttcagtaataatagaacctgaatttttcacaatactatttactgtattttcatcaatatctacaccaatagatgttgcctctagctctaagctaaatgaactgcctgctcccaaaatgacttgcccagggctttcaatggtttcatcacgttcaaaatcaatccacttaaatccccaaggattattttcacgacaatcacttgcttctccccaaatactattacaatagcgacctttaacttttttctcttgtttaaagtatttagcttcaattattcccttattttcaacatcatttccaactaaagcgacaaacgcattttcgccatttgcaacaattttaccctcattaataatttttccttcagcggttttatgattttggcgtggagtaaagttgaaattattactattgctaattttttcaagatctttagttgtagcaagtaagctacctacatttacttgagcatcttttgtaataataatgccgttaggattagcgagaaacacacgaccatttgcttgcaatttaccttgtatttgacttgcatttccgcccataacacgattataagcaatagcggttgaatctggctgtttaaattcaacactattttgttttccaatatcaaaactttcccactcaatactcactctaggtgattcttgggtaatagtcattgtcttatttaaggtgttaatttgtgcattgccgtctgtaattttatgattttgaggtaaatctgcagcataaatatttgctgtactaagtgccgttgaaatagctatggaaagtaaggtttgtttacgcatttatgttctccttaattaaaatgttttaattgcagataaccaaaattgatctttatctacattgttatattttttaccaataggttttgaataagctaaattgatagagtaattattaggttcaattaaattcaaaccaactccgatgctttttaaacggactttattctcaacagactctgataatttctcggtatttttatattgttttccaaaaccctcatcataaaagagtgagcttactaacatactttttgagaaaacaggtaagtaatgttttagttccgcttggataatatgcccctcatcaacagaaacagtgcctgcttgatatccttttacccctgataatccacctaataggaatttattgccactatctagatttttatcggctaattgcccactaacagccaacgtaatactgaaggatttaggtaaaaattgttcgtgagatagtgaataattaaatgtcgtaaatgtacgtttaggttggtaattctctgataaatagtgttttttctcattcgttgaatggctttctttcccaaaaatagtattgaaagaaaaataggtaacgccttcttttatactattccaagaaccacccagtcctatgctagtcgtatttactttccgtttttgttgtaaatcaacagatttttgttcatctgataatttctgatgattaaatgctaatttgctatctaatcttaaacttgcagttctaatagtagggtgagtaatataaccacctaaattataagtactcccttgagcattaaggtctttaaaattcgcacctaatttatattttaaatagtttgaatttatgccaactcttgtgccatatccatcaataataaaagaataatccgctcttaggttatacaaatcgaaggtattagaagcaagtacatcaaaatgtaattcatcgccaagcccaactaggttataaattttatttcctaatgttgttctatattttccagtattatcatttccttgattatcaatggaaatatatccattccaacgtttattatctttaagattaaccgtaagatctgttttacctgtattttgtcctgctttcaaagataatgctgaggtaattcctttaatgtcattgagtaatagagccaacttttctagctcattcttaaccaaatatgaatgactttttacagtggtattcaccatccgcataaccaaatcttcttttaaacgacttccatttctaacgaccacctgctcaagcgctccctttatcacgaaaatttgcaattcaccattattaatttcttgtggtggaataaaagctttagcaacaagataattattatcacgataatagttagtaatttgttgagctaaccgatttaagtcatctaaggtaatttcttgatgaagataaggcgctgtaatagatgtcagattatctttaatttcatttccgtccaactcaagcaatttcactgaatctaaacggaatttaagactttctttgttgactggaagattatcttctcgtgttggtgttttgaacagctcaccagagggttttacttttgctgcttgcatctggcgtgtctgttccaactgcttgttcaatgttcctgaatctagcattggatttgcataagtaaatccagcaacacacgaaagaatgattccagtaattacattttttctatgaaaatgtttcattttgataggtctcctttattaacaatctgttaaaactctttttatcgtttatttttaatcaaatgataagaattatcaatatcattattgataatttacaatatcttttgtaggatatttattattcaaactaaaaggagcaattaaaatgagactatcaaaaatttatacagccctctttctctctttgcctactttatcccttgcagataacaatgtttcagctgaactcgctgaaatctctgttattgcaagtagagacgcatttcactggacaaatcacacaagtcagaaagagaccttaaacaaaaatcaattattaacccaacaaccaataagtacggcagatgcacttaaacagattacaaacgtggacattgctggcggctcaagaggaatagcgcaaaagccgattattcgaggcttaagtggcaatcgtgttgttcaggtgattgatggggttcgccaaaattttgacttatctcaccgaggttcatattttttacctatggcactaactcaagaaatagaagtgatcaaaggccctacaagtactttatggggcagcggtgcattagggggaattgttgcgatcagaacaccaaatgcacttgatttattaaaagataatcaacaaattggagcaaaaattcatcaaggatatcaatctgccaattctctctctgaaacagatgtcagtgtctttgctgcaaatgagaagtttgatggattagtgagtggcttttataaccacgctgatgatttgcgtttagcagacagtaaaaaattagtagacagtcgctatactcaaaaaggcggactttttaaatttggttggcaaattaatgatgaaaatcgccttgagctttctcatcgtttaagtcattttgaacaaattgccccaactaacaatgaagttgctgaagaatttaccgaccaagatgtaagaaaacttattggaaactggcaccgaaataatctaaatgctactcctaccgagatgtctgctttctatgaaggactcacgtcggtacttggaagtgtaagttatcgagctaaacaaaaaatcacagaccaaagtagtgcactacactactactttaaccctaaagataatgattatatcaatagccaattgactctatatcgtaacagcacaaaagaaaaagaacagcgtattgcaagcggtttgcaagatcaaacaaaactcagctctgtaggtttaagcatacgcaattcgacggatctaaattggttagccctaaactatggtgtagattttatttcagaccgagtagtaacgcagcgtgagaaaaatgccacaacaccattccgccctaataattatgacgctaaatctaaaaacaatgcattttatcttttaacacatattccattatggaatgaacgcattattgtttcgccaagcgttcgttacgatcactttaaaacacaaagcgacgaagccaaatatagtgcaagtcgttggtctccatcaatcgcagcgacttggaaagcaacggattggctagatctcagcgctcgttataatgaagctttccgtacgccatcaatgcaagaacgttttgttagtggctatcactttggtgcaaattcaacaagactctcatttaagaatacctttgtaagtaatccaaacttacgcccagaaaccgcgaaaaataaagaaattgctgcgaaagttcattttgacaatctctttgtacatcaagataaattcatcttcaatgccgcttatttccaaaatgatgtcaaagattttattcatcttgatattttccgtgctccacaaagagagatgattccatctctctcacagtatcgaaatgtagaaaatgctcgcttaacaggatttgagctagaatttgcttaccagcaagaacgtttagcattgggattgaattatgctcaaacaaaaggcaaaaatcgccagacacaggaagccttatccaacattccagcgaataaattaggctttactattgattacgcgatagtgcctcaaacatttatggttggagcgaatatcacttactatgcaagtcagaaacgagtgcctaaaacacacgcaatgacttatccaagttatactctcacagatttaaaagcaagttacaccccttctggcgaatggcgtaatttacgtttggatatgatgatcgagaatgtctttgataaaaaattccaacctgcatttagcttaatggaaggggctgggcgcaatattaaattgaacgcttcttatcagttctgatttttaacaaatattgtcttaaaaaatccacgcaaatgcgtggatttttttatatactgcttccatcaatttctatcaaaattttgcttatgttatccctactttatgccttaaaaacggagaatgtgatttctgaattaaactatcaatttgcaaagatgattgatcagaaacagcaggattataactatacagctcaacagcagaatttagctatctttctgagtgcattagtttcttttaatgtgatgcaaggacatagttgtgttcgtttaaattctgatttaacaaccaatccttttggcttgcaaaaaaagaatttcagcagtgattttcatacggagattttgcaaaaaattgagggaatttcaccgcttaagtggcagtcgttgctacataaccatattgcttttagccaagatcctacacaggttgcccctttattatttcaacaggggcggctgtatttttatcgctattggcaggcagagtatcgtatagcacactatttacaacaagcggtaagttcggatttaaaaaaagcagatatcgatcttcatcgtcaaattttacaacgcttttttccaaaacaagctgatacggattggcaaaaaattgcggttgcaacggcattaactaaacgattctgtctgatttcaggcgggcctggcacaggcaaaacccgaacagttgctattttacttgcagcattacagcttaaacaattagaacagagccaaccacttttaaagattgctcttgctgctccgacaggaaaagctgcggctcgtttaaaagaagctatttcaaataatctcgctagccttgatattcctgacagtttgaaagcagaagtaccaaccagagcctcaacaatccattcgttaatcggcattaatccccatagtgatctgcctcgtcatcacgctcaaaatccactgcatttagatctgttagtcgtggacgaagcgtcaatgatcgatctcttcatactggaaaaactgctgaatgccttaaaaccagatactcgtttgattatgcttggggataaagatcagcttgcttctgtagaagctggaaatttaatgggggagttaggtagtttgatcagatttggttatagcaatgagcatagtgactatctaactgaggtaacagaacatcaaatttatcctacagtggaaaatgtccccgcaatttgtaattcattatgtcatcttcgtcgaagttttcgttttgacgaaaattcagggattgggcagttagctaaacaagtgaacacccaacaagcggtgaaatcgtggcagattttaacgaatagagcttatgatgatttaacattagcgtgttaccctaaagtcacggattttcctgaaaaatcacaatggatacaacactgtgtaaatagcgtggtagaaaaagcggtggagttatattccgattacttgaacaaagtgaaagctcgagtactttccccagaagccgtgtctatcggtgagatatttaaagcattccaacaagtacgctttttgtcagccttacgcgtcagtgaattgggcgtagaacgattaaatcaaaccattgcagaagccttattacaagcacgtttattacattttaaacatagccgagacagctacattggcaagccaattttgattaccgaaaatgcccctcaacttcatatctttagtggtgatattggcttaattcttccagatgaagcaggaagattgagagtatattttgaaacagaacaaaatggaaaacatttagacatttcccttagtcgtttgccaagttatgaacccgcctatgtaatgaccgtgcataaatcacaaggttctgaatttgatcatactttattggtaatgccactttctcattcgccagtattaacaaaagaactgatttatacggcgattacccgtgctaaaaaacagtttaccttgtttagtgaagaaaaaatttggaaacaagcagtaaaagcagaaattcaacgacaaagtggattaaaagaacaaatattggcagatattttaatgaaatgatttggaataagtggactataatccacagaaatactttagaagatgttaatggcaaattgcagaaaattctgtttcacattagaatagggtacatattcttattgatcaatgaggaaaaacatggaaactatagaaaaaatccaaaaacaaatcagcgagaatcctattcttctttatatgaaaggctctcctaaattcccatcctgtggcttttctgctcgtgcttcagaagctattgtaaattgccaagttccatttgggtatgttgatgttttatcgaatccagatattcgagctgaattaccaaaatacgcaaattggccaacatttcctcaattatgggtagatggagaattaattggtggttgtgatattgttctcgaaatgttccaaaaaggtgaattgcagaccttgttgaaagatactgcaaaaaaatattctctatagcgtctaacaatcacattattttgcagagcttgttgtataaaacagctctgccctcaattaacttcttgattttctttcaattactgatcatagtatcgctctataatacttatttcaaataatacttaattttggcatcatgattaaacgtctcatttaatgagagattattcctttctatactttttaattatttgttaaaaaattagagctatatcacaatattcctcccaaaatttaggtagaatactgatgatttcatttattcaattgtataaaggacacaactatggatgacaaatctcaattacgccaagcagcacttgatttccacgaatttcctatccctggtaaaattgaagttaccccgactaaatccctcgcaacgcaacgtgatcttgcattagcttattcgccaggggttgctgagccgtgtttagaaattgaaaaagacccagcggctgcctatcgttatacttcaaaaggtaacttagttgccgtgatttcaaacggaactgccgtgttaggtttaggcaatatcggtgcattagcaggtaagcctgtgatggaagggaagggcgttctgtttaagaaatttgcaggaattgatgtatttgacatcgaaattaatgagaaagatcctgaaaaattagttgaaattatcgcttctcttgaacctacctttggtggtatcaatcttgaagatattaaagcaccagaatgtttttatatcgaacaaaaattgcgtgaacgattgaacattcctgtattccacgatgatcagcacggtactgcaattatcagtgcggcagcagtgattaatgcgttgcgtattgtggataaaaaaattgaagaggtgcgtttagttgcatcaggtgcaggggcggcttctattgcttgcttgaacttgcttgtatccttaggtatgaagcgtgaaaatatcgttgtctgcgactcaaaaggggtgatctataaagatcgtgacgatcgtatggacgacaccaagaaacattattcgattgatgataatggctggcggacattaggcgatgcgatgccaaatgcagatattttcttaggctgttctgcggcgggtgctttaacgcaggatatggttagaacaatggcggctcacccgattatcttagcattagctaacccaaatccagaaattacaccgccagaagcgaaagctgctcgtccagatgcgattgtctgtacaggacgctcagactatccaaaccaagtgaataatgtactttgcttcccattcattttccgtggtgcattagatgtaggcgcaacaacaatcaatgaggaaatgaagcgtgcggcggtttatgcgattgcagatttagctcttgcagagcaaaatgaggtggtcacttctgcctatggtggcgagggaacaacctttggtgcggattatattatcccacgtccatttgaccctcgtttaattgtacgcattgccccagcagttgcaaaagcagcgatggaatcaggcgttgctactcgcccgattacggattgggaagcctaccacgagaaattaactcagttcgtctataaaaccaacctcttcatgaagccgattttcagccaagcaaaagcagagaaaaaacgtatcgtgcttgcagaaggggaagaggacaaagtattacacgcgacacaagaagtggtttctatgggcttggcatatccagtcttaattggacgtacggaaattattaaagccaaaatcaaaaaattggggctacatatcgttgcagggcaagattttgatgttattgataatgaacataacagccaacacgatgagttatggaaacgttattacagcataatgaaacgcaaagggattaccgaagcgatagctaaacgtgttgtaacctcaaatacgacagtcattgcttcattgctcgttgaaatgggttatgctgatggattagtgtgtggtttgtttggcacatatagtcgccatttagaagctattcgtgacattattggtgtaaaagaaagcgtaaaagtacccgctgcattaaacagtttggttttaccgacaggaaacgtttttattactgatacctatgttaatgcagatccaacggcggaagaactcgctgaaattaccttaatggcagcaagagaaattcgtcgttttggtattgagcctgcggtggcactactttcacactctaattttggttcatcaaatatgctaggcgcaccaaaaatgcgtaaagtgttagagattgtgagagagcgtgatcctgcgttaatgattgatggtgaaatgcacggtgatttagccttatcggaaaaattacgccgtgattatatgccagatagcccattaaaaggttcggcaaatttacttataatgccaaatatggaggctgctcgtatcagctataacctattaagagcgacgacaacagcaattaccgtaggacctatcctattaggtatgaataaatcagcacatattcttaacccagtgtcttctgttcgccgtatcattaatatggtggcgttcgcggcagtgaaggcttagtaaaaatgaaatgagcgtgatttttcacgctcatttacttcttattcctcaagtatttttctaaaattgtttttgataattacggctgccttgtttttataatcgctttggattctttatccatggtaacttcaattttatgatctacaaccacattcatattaatcgtaataccttcaggtggtgtttcaagttgcactttgggagtgcaagcggtcaaatttaagcaaaaaattgtaaaaagtgagtatatagctttcattcttagaagggatttgatttattaggtttatcttatttaatcatcttttttctttaacaatgaaataatctctttcaaagcaatgatttcttcatttttctgagccaacatctcgtctttatgggcaatagtgagttttaatttttcgatttcggcggtaagattttcaggctctccataatagttagtattgtgatcattcatcacaaaaatacaccttttccaccaccttgcattagctcaagtacatcaatattaaaaatctgagcgaatatctcgtattttacacatattttcgttaaataacacattaaaataaggactttctatgtgtttgtcagttaaaacagcagcaatggcaattttagtttaattaggtgtaacagcttgtggttcaggtggtggctcatctgcaccaatgaataattcagatcaatcaaatcaagttcgtaaagatagggaagtaggtttggacgttacactttggcatcgtaacctgcatttttggggaattacaccgaaaatcagctatcaatatcagcgagtgaactcaaatttagtggatctttattcgtataaacgaaatcgagtttatttgagttttgagaaaagtttctagtaaataagtggcttagataattctgagcctttagcatgtactgagtgcggttattgtttatctaattgtttatagattgagtgctcaatattctgctcaaactgagaaccgtagttaatcaatttccacaggtcgaacatattctctttatggttataattcaaattgactttcgcttgtttatgctcagtcaatctagaatggattttagctgataaatccatatcgcctttactgtctaaattcaccgttgcggtgaaatcgtcaatctcacttttattgaccatataagccaaaatctgttccgtatagcccccttgtttaatcgcttcaagcaattcaggggtaaattttaggtaagatctatccgcttgtgtcaatgttccattgcagatgtagcaaggtttacccgacagccaaaacggaaagataccgttgaatttgccagttaaatccagttggtgatactgtgccaattctaaaatgcgttcaaaacgaatatcaaacagctttaaataagcgattttcgtttgtggcagggcaaagtgttcgatatttaaacgtccatcaagcaaatttaaacttaactctcgtaaaaacagaggcttacgtttagtgtaaggtaagtgtccttgaatttttactttgacattggttatcggaatacccatattcacttcatcaatattcacatcaagggcttttttcacaccaatatctacttcgccctgtttgtattgataagggagtgagaaatcaatgcccttgatctcaccgtttggtagagaaaccgcaccgttgcgaatagcaaaatgcccgccagccatcagcccacgagctgcattcgcactaaatgacgtttcacctttgatggtaccgtttgtgatgacccattggtttctaaaaggaaaaaggctttggaatacatttgcaggttgctctgaccaatatagcttaccgattaaatcactggcattattggttaattttcggcgagcaaagagtttaatcggtcctaattgattagcggtaacatcacccctaaagttaagattttccacttcgccgtaaaaatttaagtgtgccgttggcttttctaaagtgccaccataggcaaaattaatctgcggagaaaagagttttattcccccagtgagatgaaatttatcgtaatcaaagttaatcggctcattcaaaaccagctctgttttgggaatggataccccatttttaccaatctgttccagactacctttaaattcagatagttgcactaaatctttatgccacacaccacgcccagacaccgcaagcggtcggtttaaggcttttatttgcgaactgccccaaaaacgccaattccattgatctttcaccgcttttttatcggttggatcttggaaaaagtgtaatgatcccgctttgaaattgttggcataaccgtccaaccgcatttcaatatttttaaagtcagggctttctccacggaaaatcgcttgcaatcgaccatgaatgccctgcttatctacccgtacgccagcaaggggaaaacgcaaatcgttgatggtaagaaagcgttcagtcccagttagacgtaacaaagcaccttgcaaaaagcgtaaggtgagatcatcaaattttccccttacatctaaaggaatagtgctatataaaatatgctcaccttgtttgatattacctgtaatttgtagtggcaaaatcaaactgtcttgcagaatttccccttgtggactactgatcacaacattgcctttccctttggcattttgagtaagtaagctgatacgcaccgccgtttttatcggataaagctcatctaaggaaaaacggttaggactaatcgtagttgtcagatatgcattgagcggaaaatcatttgagagttgccaatcaattttccctttttcaatcgtcaggctttgcgtatcaaaatgaaacggcaagttgaactgattttcaggtgttatggcggaatttaactgccaatttccgtgaagttgttgatcttgtttataccagttgagcgttgaatgtccttgttgcaaacttggttccgcaatcaaggcttcaggcaaatgccactgataattcaagctaagttgctggggcaatgctagaaaatgttcatctaactgagcagaaagtgttacgtgatgttgctcatcattatttggttgatagctaagttgtgtggtgagttgctgatttgcaaaatttgcgtcaaatgtgaccgcttgttgcttaatgtaagcggtcagtttttgctgaaaaaatgcaaatttaatttcacttggtgattgcagtaatcccttcaaacgttcatgcatttcgttgggaagatttttccacgccaaagatttgatttctatgttaccttctggcagtaacgcaaggatcgttttaatggtttctgtgggatcggtttggcttttttccgatttaggaaaaagagatacgcaggcgtaatcaacagtcgcttgattaagacgaatagattgttcatcaagccattgcaccgaaaggctctctgccgaaataatcggacaatgttgatagtaaatagtaaattgtggcaggattgctttttctaaatgtggctcaataccatagggtgtttctattttccagcccgttggcaatacaagattaatcgcagaagctaattgagagcctgaaagcaacgatgcaccgccagccattaaaatggcaagtgccgcaccgataatcaataggcttctgcgtaacatttagagaatatttgttaatggataaagcattgcaaggaaggtagcgaccgtccaagcagttggatttttgatgttttttccctgtttgccgagtagcaaccaagctaacatcatcaaaatcacaaactgaaccccaaagaagataaagtaaggataaatcaccatctcaggcataatcgcaagttgttgatataacacgaaaatcacccaaacatagttgatgattaataccataagtgctaacaataccaacagttttaaaaagccttccaaacggcttttcgctagcattaaataccaaccgcttaataaaataccgagtaaaatctgggcaaaattattggctctaatccagttaaacagcgacggtacttcataccaataaatcagcaaatattgcagcataccaatggcggtgatgcctaagccacaataaattaccgtacgataaatctctttatctttaggtaatttccaatagataaacggcagaataacagaagcaaatccagcgactaatgcaggcgaatgcttcggggtaaagacaagagaatagagaaaattacccaccgcaaagaccaagaaccaaggcagaatagccattaaacgccctttctgccctgggcaaatttgccctttccacagtaccacgaagttaatcaaacaaacgctaaaaaaggtgagcagataaggagaaacaaagattgcattttgtggtgcaaaatagtgattgagtgacatttcaatcaataacatcgtcaccaacggcaaaatagcgtgcgtagcgatttctaatttagaaggtgtatcgtgatcgtgagccatagtttcaattcaaaaatgattttagagcgagattatgccataatattggcacttttttctatttttaagaggattttacgatgcgaattttacatacaatgttgcgagtaggaaacctagaacgttctatcaaattttacacagaagtgcttggtatgcgtttattacgcaccagcgagaatgagcaatataaatatacccttgcatttttaggctatgcagatgaaagcgaaagtgccgtgcttgagctgacgtataactgggaaattgagagctatgaattaggcaccgcctacggacacatcgctatcggtgtagatgatatttacgcaacggttgaagcggttcgtcaagcaggtggaaaggtcactcgtgaggctggtcctgtgttaggtggcaaaaccgtgattgcgttcgtagaagatcctgacggttacaaaatcgaatttatcgctaacaaagatgcacaaaaggcgttaggttaatggctgaaacagaagcaaccaattacaatctattgaaaaatcgctttcgtggctatcttcctgttgtggttgatgtcgaaacggggggattaaatgctcaaacggacgcattgttagaaattgcggcgattacgctaaaaatggacgacgatggctatttgcatttagatgaaaaatttcatcgccacgttaaaccttttgaaaatgccaatatcaatccagaggcattaaaagtaaatggaattgatgtagataatgcagagcgtggtgctgtgccggaagatattgccattaccgagatgtttaaaatggtacgcaaagcggtaaaagacaacggctgccaacgtgctgtgattgtggcacacaatgcaacttttgatcaggcatttctacaagcggcggtaaaacgcattaatgccaaacgagatccgttccacccttttgcaatgtttgatactgcaaccttggctggttttatgtatggacaaacggtcttagtcaaagcctgccaaatggcacaaattccttttgacggcaaacaagcccattctgccttgtacgatacggaacgcactgcagagctgttttgtgcaatggtgaataagttgaaggatttgggtgggtttcccgatttaaaggctagaatgtagtaaaaggtgagaaattagaggcgcagcttaatttctcactgctattatacttaaatatactatttgcgatatttcccagccattgcctgataaatggcattctcatttttgagcagggtgtatttattttcaagcaatgaaagttctgagctacgttcggtgttcattgcacttagccattcacgcaattcagagataccttgatcgtagcggtttttataatatccgctgatttttctatcgtactcatattttttctgtaaattcgcatagccactttttgacagttggtaagtggaatagtaggtgtcgatttcatttaatgcggttgttactgtctgttcatagttcaatttagccagcttataaccctcttctgaaatcttaatgttattttgtactctgttccaatctaagaacggcaaatcaaaagacaccacgccaccagcgacagggttatctgacgtattgttaaacttcgttgaacttcctgttaggcttcccactaatgtgactgtcgggaaccagctattttcagttgcggtgaggtttttaaatgccccttgtaaacgttttaggcttgccagtacatctggacgattagcaatggttgaaacaggaacattcacatcaacatcttgtaatttaaccttaagaatacttggataattgactacaagcggttcgtttggttttaaatttagcaaattacgcaaaacttgttcacttgatttttgagctgattgtaagttgattaaggcattttgtgcagaaagcaccgcttgcattgattgatctacgctaagttggtcgattaatccctgtttgaatttgttgcttaaaatgtggttgatctgttcatagcttttcacgctctgctgcgtaatgcggatcgcatcttgataataggcaagattgtaatagctacttacaacggcattaattagggataatctcgccgcttgtaaatcttcttgggttgctttgtgttcccactctaccgcacttgcggtatctcttaaacgcccccataaatcaagggtataacttaggttcaagccaatttgatgaccaatacttgatgttcctgtcgagtttaggttactgctagatccaaccccttttgaagcagaagatttttccgaagcggtgaaagtcggaactaaatttgcacccactaagtgtgcgttatataaggctttattcacagaaatagctgtttttgccaaattgatattattggcaagtgccgtttcaactaagcggttaagctgagtatcattatagcctaaccaccattgctcattgatttgatattgtttggtaatatcttgatattgttgataatcttgctgtgctttttgtagagagccatcgttgctcatattggtacaagctgaaagtaccagtgcagaaagtaatgtaaaagtaagttttgacactttcattaaaaattccttgattaaaaaataatggggcgtattttaaagaaaacgccccatttcgaccagctctaaactgaacgatcattcattttttgcaaaaatttacataatgtattgacttgttgatcaatttccatcgttatataattttaaatataatgattttatcttaatcacaggagctagattatgaaaaaatttctttctgcattcgctttgttggcgtttgtgacaagtggtgtgtctgccaatgagcagccgatcagtacccatttgggcgatttacccaaagctgagcgtgtacaaaaaattatcagtgcaggtaatccaagtgatgttgtgttacttgctgttgcccctgaaaaattagccgggtttgccggcttcaaaatgcaatcgacatcaggcaaattattccctgaaacgttacagaaattagaaacgctagggagagtttcgggcaaaaatagtagtttatcgcctgaaaaaatcgtagcgttatcccctgacttgattgtcgatgtgggtaatgtgtcaccaaactatcttgatcaagcaaagaaaactcaagctcatactcaagtgtcttatgttttattggacggtaaacttgaacgtaccccggaattgttgcgtgaattagataaaattgtggggcagacgaaacaggctgaaaccttggcaaaatatgcggaagaaaccttaaaacaagcggttggttctgcgaaaaatgttgcaaaaaccgcttatcttgcacgaggtgccgacggcttggaaacaggctttaaaggttcaatccatacggaggcgatggaactggtcgggttgaaaaatgtggtggaaggggaacataaaggtttggcgaaagtgtcaatggaacagcttttgcaatggaaccctgacatcatttttacgcaatttcctgaattttatcaaatgatttgggaagcaccgcaatggcaagcactagatgcggtgaaaaataagcaagtctatttaatcccacatcaaccttttggttggttagactcgccaccaagtttaaatcgtttgttaggtatgaaatggctacaacaccatttgtcaggcggtgaaccgaaggcatttattcctgagttaaataccttttacaagttgttttatcatattgatttaactgacgcacaggctaacgaattattaccgaaaggtagataaatgttcggttgagatgatctccaaacggtcgctactgatattgagtttgctcttattactggctattttgctttcgcttaatctcggaaagtatccgatttcgccgacagcactgtggcaagcggtcgtttgtgctttctctgttgaatgcgaaaccaaccaagttcaaacggtgttatggcatattcgagtgccacggattattgttgcttgcttagtcggggctgcactagcttgtgcagaggcaacctatcaggggatgtttaaaaacccgttggtttcccccgatattctaggcgtatcggcaggggctagttttggggcttcgttggcgattttttgcaatttgccgatgtggtatgtgcaactttttgcatttgtcggcggtattagtgcggtattgttggtaactgtgatactggaaacgaaaaacctaacgattggctatgccagtcagcctttgatctcagggatcgattttcgtctgggaacaaatgacatctgctgtgtgttaggggcaaatggggcagggaaagtacctttttacgcacgttattgggtactcaagcaaaattgcacggggaaattttctttgcaaaccaaccgcttgttacctattcaccacaacagttagcccaacaaattgcctatgtgccgcaagcgcatcaaagtttatttccctttacagttgaagagatggttttaatggggcgttcggcttatctaaaatggtatcaaagccctagccataaagataaacaacttgcttttaacgcattggaacagctaaatattgtacatttagctcaacgttactatccacaattaagcggtagtgagaaacagttagtgttgatagccagagccattgcacagcaagccaagatgttgattatggacgaaccaacttcaagccttgatttcggtaatcaaattcgtctgctgaaccaaattaaacgactacatcaacaaaatatggcgttactgatcactacacatcacccacagcactccgattaccttgcagatagcgttgtgattttagataaacaacatcagccagcctttcaacaagggaaaaaagccgctatgctcactcttcatcaactagccaaaacctatcgtattgatatgacaagtttggctcaacatttaccttttaaggaataacatgaattcattctacgacattgattttgctcaactttataaacaacatctgattgcatatcgttatcatgatgttaccgctgagaaatgggataagaaagcggttagatttgccgaaactttgttgaaaaagagaacagttatacccgtcaatttctagataaaatgaagattgaaccgacagatagtgtattggatattggctcaggaccggaaacgcttgccattcccctagcccgtttatgcaaacaagtttacgccttttatatctatctgttaaaccgtctttatcagcgtggtattcaggcagaactgacttttttacagggagaaacagggggcttgcaaggggaaacataccaagatctgcaaaatgccgtggagttttcgctagggacattaaccgaactagaacgacaaaaattacaggccttctatcagcaaaaacagcaatctcaacaaaaaatcagccacgatcaagcccgttgggcgtttatttcgtggcaggtgtagaatatcgacaaatataagcggtgtgattttgcagaattttctatataacctaattgcgatggtataaagaaaaagtcttcaccctagctcaaatcctgagacattcctttaagagaatatatcaggctttccaaaacaatattgccctaattacatgttcaatactttcattttgcatattaaaaaacagtggcaatctcactaaccgctcgctctctttagtcgtccatttgtcttctccacaaaatcggccaaactgctgccctgcagggcttgaatataatggcacataatggaagaccgtcaaaattccttttgatttcattgcattaataaaatccgttcgcaccttgagattttgccattttatataaaacagatgggcatttgcttggcactcttggggaatgtagggcaattccacaatccctttctctgccaaaggctgtaatgcgtcaaaataacattgccaaatcatctgccgtttttgttggatttgttctaacccttgtaactgagcataaaggtaagccgcttgtatttctgacattaaaaaacttgagccgagatctcgccaactatacttatctacttcgccacgaaaaaattgctgacgatctgtgcctttttctcgaataatttcagcacgagcggtcagttcaggctgattaatgacaatcgccccaccttctccccctgcggtgatatttttcgtttcgtggaaactgtaacagccaatatgcccaatcgtgccaagtgctttccctttataaaacgcattaatcccttgagccgcatcttctaccacccataagcgatatttctgtgccaatgccataatgctatccatttcacacgccacacccgcataatgtacagggacaattaccttcgttttgggggtaatcgcttgttctatcaaggcttcatcgatattcatcgtatccggtcgaacatctacaaacacgattttcgccccacgcagtgcaaaggcatttgccgtagaaacaaaggtatagcttggcataatcacttcatcacccgattgaatatcaagtaaaatcgctgccatttctagcgccgccgtacaagaaggtgtcagtaacactttatgtgcgtgaaaccgttgttcaagccattgctcacatagacgggtaaagtgaccatctccagatagcttatctgaacagatcgcttgctggatataatttagctctgtacctaatacaggcggttggttaaaaggaatgttttgcatcatcgataaaaccaataataagtgccgctgatttttccgtttaagcgttgataaagccgaattgcagctaaattgctcagctgggtggtaatcaccattttcgtcgcttgctgacgtttcgcccaagcgatcgcattcattaataagcgatagctaaccccctgcttccgccatttttctgcgaccgccaacaagccaatatgtgccgtagtctcttttactcgaagggtaatcatcccttgtatttcaccgcttgtggcttcactgagtaaacaaatatcgtcaaattctcccttaactgcatttttaatccattgccaataaaatcgacgattttctaacaatgaaaaccaaggcgaacgaaaacgcgtttgtgaaaacaaatgcgaaaagggttcaagttgaaccaaatcctgttccgttgccacacgacaagcggtcagttcaggtgaaaaatgtgcaagatcatattcaaaaacaatctcaccttctacaaactgaaaatcttgctgctgcacccaagctatttccgttattgcccagcttggcaattttgtttgaatgagagagaaatcagcgagaactaaatccgagttgctccctttactaataagatccagatcagcgatatttcgaccaaaaaaattagaaagccaaaggtgcttatacatttttcctctcttattcattaattatctttcacatatttaaactaggctgattttagtcatgttttttcattatattgaataggagcaaacatatatccgatattttttattgtacgttatatattgctaagtgacgataaaataatttacacattcaatctagccaaaagttttgtaaataggtacaatcaaacgcttgcattttattaacatttgcgaagaaaaatttaactttggagaacgttatgtcgtggaacgaatcaggcaatcagcaagatccttggggtaaaccagggcaaaaaaagcctgaacaaaaacaaccatcgggtcaagaaaaagagccgaataagcaatcaaatgaacagcaaccacctgatttagaggaagtttttaatagcttattgagaaaaatgggtggcggtaaaggcaatggttcaaaccaaaataaccgtccagctgtttctgcaggaaaatttttacctgtattactcggcttaggcttagttgtatggggagcttcagggttttataccgtccaagaggcagaacgtggtgtagttactcgtttcggtaaattacacgaaattgttttacctggtctaaactggaaaccaacttttattgataatgtaacgccagtgaatattgaacgtgtgttagaactgagaactaacggctctatgcttacccaagatgaaaatatggtgttggtagaaatgaccgttcaataccgtattgaagatccagcgaaatatctctttagcgtgaccaaacctgatgatagcttgaaacaagcgactgacagtgcattgcgttatgtgatcggacatatgacaatggacgatattttaaccacagggcgtgcgattgtgcgtgaaaaaacgtggaatgccttgcgtgatattatcaaaaattatgatatgggattattgatcaccgacgtgaacttccaatatgctcgtccgcctgaagaagtgaaagcggcatttgatgatgccattaaagcacaagaagatgagcagcgtttaattcgtgaagccgaagcctacgcaagagggcaagagccaattgctcgtggtcaagcacaacgtattttagagcaagcaaatgcctacaaagagcaagttgtgttaaatgctcgaggtgaagtacaacgctttactcaattattgcctgaatataaagccgcaccagaagtcactcgtgaccgcttgtatattcaaacaatggaaaaagtgatgaaaaatacaccgaagttaatggtagatagctcaaacggcaataatctaacggtgttacctattgatagattgatggctaaatcaacgacaaatgaagcggtaaaaacaccatcatcacaacctgttattcaacaacagccgcaacttgctcaacctgttagccctgctcaattacctgcagtggaacagaatgagcctgtgcgtaaagggagattttaagaatgcgtaagttacttttacctgttttagctgttgtgacatttatccttttccaatcggttatcgtagtaaaagaaggtcagcgtggcattatgttacgttttaacaaagtacatcgtgatgccgataataaagtgattgtttataaaccaggtttacactttaaagtgcctgttatcgatcagctaaaaaccttagatgctcgtattcaaacccttgatggacaagaggatcgctttgtcacagtcgagaaaaaagacttgctagtggactcttatgtgaaatggaaaatcagcgattttggtcaattttatacttcaactggtggcgatacacaaaaagcttcaaccttattacaacgtaaagtcaatgaccgtttacgttctgaaatcggttctcgtaccattaaagacatcgtttcaggttctcgtggtgaactgatggcaggagcgcaaaaagccttgaatgatggcgaagatggtgcagaacgattagggattgaagtagttgatgtgcgtgtaaaacagatcaacttaccaaatgaagtatcagcctctatttatcaacgtatgcaagctgaacgtgccgccgttgctcgtgaacaccgttcacaaggtgaagaaaaagcagaatttattcgtgctgatgttgataaaaaagtggtactcatcttagccaatgcaaataaaaccgctgaagaactaaaaggtcaaggtgatgcagaagctgctaaaatctatgctgaagcatttaaacaagaacctgaattttacagttttgtgcgtagtttaaaggcttacgaagaaagttttgctgcaggctcaaacaatatgatgttgcttaaaccagacagcgaatttttccgctttatgaaagcacctacaaaatagttatatccaaagacccgataaagcgggtcttttttatctttaaaatagaaagctacaacgaggttgtaaaattttaggttgttatataacagtttatattagccaaaatgtagggacacactgagtgtgtccgctcataaaagatcatgttgaggacacactgagtgtgtccctacagtatgcctgaaagattgaggtttagcgtaactgtaacaaccaaaaaaatctaaccgcttgtatgcttttgacattcactaaacctaactaaaagaggcaatttattatgggtaaaagtgttgcaatccttggagctcaatggggcgatgaaggtaaaggcaaaatcgtagatttattaacggatcgtgtgaaatatgtggttcgttaccaaggtggacataatgcaggtcacaccttaattatcaacggcgaaaaaaccgtacttcgccttattccatcaggtattttgcgtgaaaacgtgacctgcttaatcggcaacggtgtagtcctttctcctgcggcattaatgcaagaaatgggcgaattagagtcccgtggtattaatgtgcgtgaccgtttaaaaatctctgaggcttgcccattaattctgccatatcacgttgcaatggatcacgctcgtgaagcggcgttaggtaaaaacaaaatcggcacaacaggtcgcggtatcggtccagcttacgaagataaagtctctcgtcgtggtctgcgtgtcagcgatctattcaaccgtgaagcctttgcagaaaaattaaaaactattttggaatattacaacttccaactagttcactactacaaagttgagcctgtagattaccaaaaaaccttagatgacctttttgcggtggcagacatcatcacaggtatggttgcagatattacaaccctattacacaaagcacgagccaatggcgacaatatcctgtttgaaggtgcgcaaggcacaatgttagacattgaccacggtacttatccatttgtaaccagctcaaatacgactgctggtggtgttgcaacgggttctggcttcggacctcgcaatttagattatgtattaggcatcatcaaagcctactgtactcgtgtgggttcaggtccgttcactactgaactttttgatgaagtcggtgcagaaattgctcgtaaaggtaacgaatttggtgcagtcacaggtcgcccacgtcgttgcggttggttcgatgccgttgccgttcgccgtgcaattcaaattaactcaatttcgggcttctgtatgaccaaattagacgtacttgatggctttgaggaattaaaaatctgtgtcgcatacaaattaccaaatggcgaaatcgtagaatactcaccgcttgcggcggcagactgggaaggggttgaaccgatttatgaaaccttaccaggttggaaagagaatactttccgtgtaactaaattagaagatttaccgcaaaatgcgatcaactacatcaaacgcattgaagaagtgttaggtgtaccagtcgatattctttcaacaggcccagaccgtgttgaaacaatgattttgcgtgatccgtttgcagagtaattagattttaacgataacaatctcctagtttgtagaaattaggggattttttgtataaaacagctcggatctgaccgctagtttacatttatgttgcgaacttagtgacaaagtagtgtaaaatagccaagttttcgtgatttattattcatagaggaaaaagaatgaaaagagtcgtcatcacaggtatcggcattatttcgagtatcggtaataacaaagaagaagtattagcttcattaaaagaaggtaaatcaggcattgaatttgtacctaaatttgctgaagtgggtatgcgtagccaagttgctggaacaattaaattaaaccctgcggaattaattgaccgtaaaatttatcgctttatgggcgatgcagctgcttatgcttacctttcaatgaaagaagcaattgaagatgctggtttaaccgaagagcaggtatctaatgatcgtacaggtttaattatcggtgcaggtacaggctctgcacatagtcaattagtggcttgtgatgcagtgcgtagtcctcgtggtgtaaaagcaattggcccttatgccgtaactaaaacaatggcttcaagtgtatctgcttgcttagcaaccccttataaaattcgtggtgtaagctactctatcagctctgcttgtgcaacctcagcacactgtatcggtcacgcaatggagttaatccaattaggcaaacaagacgtggttttcgctggcggtgcagaagagttatcttgggaatgtgcaacggaatttgatgcaatgggtgcagtttcaaccaaatacaacgaaaccccaactaaagcttctcgtgcttacgatgccaaccgtgacggcttcgtcatcgcaggtggtggtgctgttgttgtggttgaagagcttgaacacgcccttgctcgtggtgcaaaaatttatgcggaaatcgtaggctatggtgcaacatcagacggttacgatatggttgccccaagtggtgaaggtgcggaacgttgtatgaaacaagcgatggcaacagttaaaggcgaaatcgaatacatcaacgtacacggtacatcaacaccagtgggtgatgtgaaagaattaggcgcaatcaaaaatgtctttggcgataaaaccccagcgatttcatcaactaaatcaatgaccggtcactcattaggtgcagcaggtgctcacgaagcgatctactcgctattaatgttagataacgatttcattgcaccaagtatcaacattgaagaacctgatgaacaagcacaaggtgtgaatatcgtaacagaatgccaagacaaagcgttaacaaccgtaatgtctaacagtttcggcttcggcggtacaaacgcttgcttagtcttccaaaaatatcaaggctagtcttgcttaatttatgaaatctgatataagggcgtgggaattttcccacgtcttttttatttatttggagtgaataatgttaaagtttaaacatttattatctattttagtattagcaatttcggcaaatgtagtggcaagtggtgtatcaatggaaatgttccaaatgaaacgccaaattaacctattaacaaatgcccaaacagctgaagaatttacgcaaaatgcagataaatttatcgaagtgtctaaaaaagcccaagcaactatgccaaacagcttagatggcgatcaagaaaaattcaaaggctatcaacaaggtatgcaagaagtcatcgatgttgttgctcaagcaaaaaacttagcaagtcaaggtaatttaacggaagcaaaaacagttattgcgcgtttagatagcttaagaaaactgtatcattcggcatataaataaacggacgaaaatggtgtaatagacaaatttgttgcaaaaaagcagcttaaaaaagtctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacataacggttacacatctaagaccgtcatttgtgatgaaggtgagatagaaattgagacgcctcgtgaccgtgacggcacctttgaaccgcaacttatcaagaaaaaccaaacccgcatcacaggaatggatgagcagattattgccttatatgccaaagggttaagtaatcaggaaatcgttgaaatgttcaaagaactctatgatgcggatgtatcaaccagcctgatttctcgcgttaccgacgccgtgaaagagcgcgtaatggcatggcaaaatcgcccacttgatgcggtttatccaattgtttacctagattgtatcgtagtttcagctttgcattgtgcatttagtgcgtaacagcttgaaattcgtttcgtggaaagattacaaagcagtcactgcagatttaaagcaggtttatcaagctcgcgaaaatctgaccgcactttcgcaaaaatggcaggcaaaatacccgcttgtggcgaaaggctgggaagataactgggcaaatattaccacattttttgattatccggctgatattcgtaaagcgatttataccacgaatgccgtggaatcgcttaatagcgtgattcgtcgcgtgattaaaaaacgaaatgtattcccgacggatgattcagttttcaaagtgatttggcttgcgattaaagaagcatcaaaaaaatggacaatgccgattcagaactggaaactggcgatgaatcaatcataaatgagccgctcgtagcaattttgtcgttctcaaaacagattgtacagaatatgaaacagagcctattcggtgcatttatttacaatattgttgccattccgatcgcctgcggtgtgctttatccttttactggttggctattaaatccgatgattgcagcagtagctatgacattgtcgtctgtgactgttgtgttaaatagccagaggttgttaagataaaagtaaaaaatagagagcaaaaaagaattctatttaccttcgtgtcattaccagccccaaccattcaaggagtgatagaggatcactatttaggtgtctgcgttactgttagattcatctatttcagtatttttgagtaatgttattatgctgaagcataacaatcttattttattgcttacagctccgtgccgtaaaactccgctatttttgttcacatccaacgaaaaaagagaaatataaaagccttgaagtttttacatttcaaggctttatattatgtttgtctagatctgctgaaatcaatttggtggagataatcgggatcgaaccgacgacctcttgaatgccattcaagcgctctcccaactgagctatatccccaaaattgcgagagatgatatgctctcgctttttttctgtcaatctgaaaacaatggaaatagattaattgattaaaaactaactagttctgcgcttcaataaacgcaatcgctttttgaatacgcgcaagcgttctctctttaccaactaacttcgcagtaatatccatagatggcgactgccctgagcctgttactgcaaggcggaatggcatacccactttacccataccgatgtcaagctctgcggcagtttggctcattgcatcgtggatattttcaacactccaatcatcacaagcggtcagtttttccaataattttgcaagtggtgcaactgcttccgctttgaagtttttcgctaccgctttttcatcatagctatcaaattcttgatagaaataacggctttggcttgctaattcttttaaggtttttgcacgttcgcttaagactggaatgatctctgctaatgcaggtccttgagagaaatcaaccccctgatcattcatatgccattcaaggtattttgccacatagtctgcaggcaaactacgcatatagtgttggtttagccactgtaatttttcagtgttaaaggcacttgccgatttgctgacagaatgaatgtcgaataactcaatcatctcttcacgagtgaagatctcttgatcgccgtgtccccagcctaaacgtacgagatagttaattaaggcttcgggtaaatagccatcatcacgatattgcattacgctaactgcaccgtggcgtttagagagtttttgaccatcatcgccgttaatcattgaaacgtgtgcgtaagttgggatttctgcccctaacgcttttaaaatgttgatttgacgtggcgtgttgttaatatgatcttcaccacgaacaacgtgggtaatgcccatatcccagtcatcgacaaccacacagaagttgtaggtcggtgcgccatcggtacggcggataattaagtcgtctaattcgctgttgctgatttcaatgcgtccacgcaccgcatcatcaaaaatcactgatccttccgttgggtttttaaaacgaacaacgtgtggttcgctcgaatcgtgtgaatgatcgcctaagcagtggcggtcataacgaggtttctctttattcgcttcttggtttgcacgcaattcatctaaacgctcttttgagcagtagcaacggtatgccgtgccttcttcaatcatttgatcgatcacttggttataacggtcaaagcgtttggtttggaaatatggaccgtgttcccacgctaagttaagccattccatgccttcgataatcgctgcggttgcttctggggtagaacgctcaaggtcggtatcttcaatgcgtaatacaaattcgccgttgttatgtttagcatataaccaagaataaagtgccgttctagctccaccaacgtgtaaatagcctgtcggacttggtgcgaaacgagtacgcaccttcacatttggatctaaagggaaaagggtttcaattttcatattatcgcctatattttttcagaattttctaaacaaaaaggtttcggtattttacccctcttgagcggaaatcatagtgaaaagttgacagtttaggtgaatttttcaacgaatagcccaaaaatagcaaaaatggattgactgaaaatttttgaactctataatgccaccccacaacgacgggcgattagctcagttgggagagcacctcccttacaaggagggggtcactggttcgagaccggtatcgcccaccacttcaacttttgaagtccgttgttacaatctaatttagtttgaaaagggcgattagctcagttgggagagcacctcccttacaaggagggggtcactggttcgagaccggtatcgcccaccacttttttaaagtaccaacctttcaaacttcccattagtttaaatgcttatcttaagtgggcgattagctcagttgggagagcacctcccttacaaggagggggtcactggttcgagaccggtatcgcccaccacttaatccaagtgtttaaactagtcgaaaccgcaaggtattcgggcgattagctcagttgggagagcacctcccttacaaggagggggtcactggttcgagaccggtatcgcccaccatttcacttttcatcaatctccttcttattttgcaaattttttgtttgatctgaccgcttatctttgactttttactattttttcgatctctgtcgaaaaatttatctcttgtcctttctcttttttacatttcgattaggctttttctgtttttccctaaaactatacgttttaaacgtatatttaacttaaaaataggagtagaataatgaatgtcgcttttgtggagttgccgccttttgaggaatatagaaaaaagtatcttgacgatgacacatttagattattacaaaatgagttattaaaatttcccgataagggagagcttattcaaggtactgggggactaagaaaattgcgtattgtggatattattagacaaaaaggaaaaagaggcggagctagggtaatctattactattatgtacaagggaaacaagtttggttgttccatgcctataataaaaaccaacaagacgatttatctaatgaagaacgtgtggttttggcgaatacattaagctatttaaaatctttagtgaggtaagatatgggaaaattatttaatgaactaatggaagggatgcaagcattagagttgcatttaaaaggcaaaatcacattaaaaaccactgtcgtagaaattccggatccgatagtaattacccctgaagaagtgaaagctattcgccaaaaattaaatctttcacaagcggtttttgctcgtaaattacacacttcggtgagaacttatcaaggctgggagcaaggaagaacaaagcccaatccgcaagcggtcttactattaaaaatggttgaaaaatcgccaaaaacatttgagcaaattgcgagcatttaagtgaatatcggcttgtttaccgcaagccgaactatttttgtgatccccgtcgaaaaattcattatttcaacttttcaaatcttgtaaaaatcactagcctaaacgagcagacaacagtagaattgccgcctttaatttaactaaattccagcaaaactaaccttttgccacaaaccgtgtaacaacgaggctttcaaacaatgtctgaacaaattcaagcaaccgatgcaagttgtaattcaaccaaaactgaaaaaattaacttattaaacttaaatcgtcagcagatgcgtgaactatttgcggaaatgggcgagaagccatttcgtgctgatcagctgatgaaatggatttatcattttggtgaagataattttgataatatgaccaacatcaataaggtgttgcgtgaaaaattaaaacggatcgctgagattaaagcacctgaagttgccgtagaacaacgttctgccgacggcacaatcaaatgggcgatgtgggttggcgatcagcaaattgaaacggtatatatcccagaagatgatcgtgctaccttgtgtgtttcttcgcaggtaggttgtgccttggcttgtactttctgttcaacggcacagcaaggctttaaccgtaatttaagcgtatctgaaattatcgggcaggtgtggcgtgcatcaaaaattatcggtaactttggtgtaacgggcattcgtccgattaccaatgtggtgatgatgggaatgggtgaaccattgttgaatatgaataacgttattccagcaatggaaattatgttagacgattttgcttatggtctatctaaacgccgtgtgactctttcaacatcaggggttgtaccagcgttagataaaatgcgtgagcagattgatgttgcattagcgatttcattgcacgcaccaaacgatgaactgcgtaatgaattaattccactgaataaaaaatacaacattaaaatgttaattgattcagtgaataaatacttagaagtatcaaacgctaatcacggtaaagtgacgattgaatatgtgatgctaagccacgtcaatgatgatgtggaacacgctcatcagttggcagatgtattgaaaaataccccaagtaaaatcaacttgatcccgtggaacccgttcccagaagcaccctatgcgaagagttcaaatacgcgtattgatcgcttccaaaaaaccttgatggaatatggctttacggtgacagtgcgtaaaactcgtggtgatgatattgatgctgcctgtgggcaacttgcgggtgatgtgattgaccgcactaaacgcacctttgaaaaacgtaaattcggtgaagggattgcggttcaaaatcagtagtatatttcaaggtagagacacactgcgtgtgtccgttccaacaatcgtaattcgtatcggcggacacacgcggtgtgtccctacatagagggaagtcaaatgacctttgcaaaatttttccgtaatttgaccgcttgtagcgtggcattatggcttgttgcttgtgcgaaccaaactactcaggtggattttaaccgctcggaagccgtcaaagctcgcattaatttggcccttgcttaccttgaacaatctgattttccaaaagcgaaagagaacattgacaaagcgcttgaacacgatgtaaaagactacctaccgcactctgtgcttgcctattattaccaacaaactggcgataaccaaaaagcagaagaagcctaccagcaagccttgaagttaagtaaaacacagagcaaaaacaatcaagttcgccctgatgtattaaataactacggtacctttctgtgcaaacaaaagctgttcgacaaagcttatcagcaatttgaaacggcattaaccagtcaagaagcctattacaatcaagcagatacactagaaaatatcgccttatgtgccaatatgaagaaggatattgagaagcaaaaaacagcactatctcaacttgagaaaatagataaatcaagagcagaacgactatataatttcatggagattagataggcttattttcttaaactagcgtataattcgctcaatattttattttagctaggatatgttatgaaccatcttccaattgcaaatgaagctctacatctttatacacaagctatttctcgcctcaatcaacacttatctgaagcctttaatcaagccgttgatatgatattaaactgcgaaggacgagttgtagttgcaggtattggtaagtcaggattagttggtaagaaaatggttgcaacctttgcttcaacaggcacaccaagtttctttttacacccaacggaagcctttcacggcgatttaggtatgttgaaaccgattgatgtagtgattctaatctcttacagcggtgaaactgatgatgtaaataaactgattccaagtttgaaaaattttgggaataagattattgcaatgacgggaaatctgcaatcaacattggctcgtcacgcagatataacccttgatattagtattgagcgtgaggcctgtccaaataatcttgccccgacgacctcaagtttagtgactatggcattgggcgatgtcttagcgattgctctgattaaagctcgagattttaaagcggaagactttgctcgtttccaccctggtggtagccttggtagaaaattgctttgtcgtgtgcgtgatgttatgcagaaaaaattgcctattatctgtccgctttgtagttttagcgattgcttgaatgtaatgaatgaaggacgaatgggggtagctattgttatggaaaatgagcaattgctgggcattattaccgatggtgatattcgtcgtacacttgctaaatttggtgcagaaagcctgaataaaacggctcaagagattatgagctgtaatccaaaaacgattttagatagcactttccttgctcacgcagaagagtatatgaaagagaaacatattcactcattaatagcggtcaatgaagcaggaaaagttacgggcattgtggagttcgcaagctaatggcaaagtcaaattatattactcgttctggttggcaagcattagaccaagagctgaaatatctttggaaagaggaaagacccaaggtaacacaggcagtatctgaggctgcagcattaggtgatcgcagtgaaaatgcggaatatatttatggtaaacgccgtttgcgtgagatcgatcgccgtgtacgttttttatccaaacgtttggaagtactacaaattgtcgattaccacccttctcaagagggtaaagtcttttttggtgcttgggttgaactagaaaatgaggaaggtgaaataaagcagtatcggattgtgggctgtgatgaatttgatccagcaaaacaatggatttcgattgattcccccgttgcaagagcattaattggcaaacaaattgatgatgaaattcaagttgaaactcctgctggaaaagtgatgctctatatcaataaaatttggtatgaaaaaaaactaaccctatgaaaagtttagcctttattcaagaaatgctataaattcatcgttttgattagtaactaggcaagcggtctgtaattttaatttttttgcaaaaataatttgacatatttccagaacctagtaatatgcacgcccacagacacagtgagtggtgagatggccgagcaggctgaaggcgctcccctgctaagggagtatggggttaaaaagctccatcgagggttcgaatccctctctcaccgccatttactttatcatgcacccgtagctcagctggatagagtactcggctacgaaccgagcggtcagaggttcgaatcctctcgggtgcgccattttatttttttatttatcaggataaaatggttgctgataaaataaataacaccgtttcttttcaaatacgcacccgtagctcagctggatagagtactcggctacgaaccgagcggtcagaggttcgaatcctctcgggtgcgccatttcaaactaacttcctaatttcatttagtatcattaaaacggtttttatgctgacttttgcacatcaagaacatattcgtacatactattccgatactcgtaatattcactttcaattgcctcatctttcaagcaatcaatctgtggacgtttgcgtaattggtgcaggctttttagggctttctaccgcactggagctggcagaaaagggtaagaatgtgattgttgttgaaggtgctagggttgggtatggtgcatcgggacgtaatggtggacaagcaatcaacggttttgaagaagggattgatgagtatattgaacaagttggcgaagaaaatgctcgtaaactttggaatatgtcccttgaagcgctcgatattattgacgagcgtgtcaaaacctacaacattcaatgtgattggaagaaaggctatgcaacacttgcattaaatcatcgtcgaatggacgatttgattgcgattgaaaaagagagccgtgaacgctttggctatcaacatatgcaactatgggatagggcaaagttagaacagcatctaggcagtaaaatttattgtggggcgttatacgatagtcaatctggacatttacacccattaaattattgtctagggttagcggcagcctgtttagagcaaggggtcaccatttacgaacacactccagcccttgatctacaattttcaggtaaacaagttaaagttattaccccacaaggtactattaccgcagataacgtcatattggcaacaaatgcttatatcgacgctaaatctaataagaaaattggttttaaacttgcacgcaaaattctccctgtggagagttttatcattgcgactgagccattaactcaagcaatggcggatagtgttatcaataatggtatgtctgtctgcgataacaatattttgctcgattattaccgcttgagtgcggataatcgcttactctttggtagtgactccagttctaatgttgatatgatggcaaaaatgcgtcgcaatatgcttgatgtgttccctcagcttgaagatgtcaaaattgattatggttggggtggtccgattgatatgacattaaatgcctctccccactttggtcgagtgaaacctaatgtttattttgctcacggcttttcaggtcacggtgttgcattaacaggacttgctggtcgtattatcgctgaagccattgaaggcaatgacgaacgcttgcgtatttttgaagccctgaaagtgccaagtttatttggtggaaagcttgtcaaacaaatggcacttaaaattggggtgaattattatcgttttttggatcgatatagataggatagagcatagtagacaaacttcaggaatactgtcaatactacgcctagccaagttatatcaaaagtatacttaaaaatatctaactaatgttttgcgtgtgcgacgctgtttaataatttatccgtataagccacgccaattgcagataaaataaagccaatatggattaataattgccacatcattgtttcagggcttaagtttgcagcgttgatgaaggtttgcagtaagtgaattgatgaaatactgataatcgccattgagagcttcactttcagtaccgaagcattcacgtgatcgagccattctggctggtctgggtggttatcgacatttaagcgtgatacaaaggtttcataccccccgacaatcaccataattaataggtttgcaatcattaccacgtcaataagatttaacactgctagcataatagtgttttcgtccatcacaccgagattaaccactaaattccataaggattttaagaatttataggcataaatcccttgtaccacaattaaacctaaataaataggaagttgtaaccaacggcttgcaaagataattttgctaaaaatactttgttttaactgaatgttgtttaatgtattcatagttgtttctcaataaaataaaagcggtgagattttaacaattttttgtaaaagaattaacaaatctgactgcttgaatcagggtaaattatttacggaattgttttccatcattccacgaaaccgtatattctgtcggtaagcggacgcttggtaaggctggcacagccgctttgccaatcgctaataacatcactggggcataacgttcgctgtcaatttctaggacttctaacactgccttacgatcaaaaataccaatagcgtggctatcgtaacctttctctttgacaactaacattagctgcattgccactaaactcgtatcaatcaacacttgatctcgaatatcctgtgtgctgagtgtattgtgtacgcccattaagaaattaaaggaattttcgcgaaaattttggtgtaaacagccgcttgcaatagaatgatctaacacatcgccaagtaacttttcataatgaagatccgccaaaatgacgactaccgctgaagcactttcacaaggcggtgcgttaaaggtgactttatccaacagtttctgtttttgttctgcctgatccaatatcacaaaccgccacggttgaagattggcttttgatggagcaagctgggcaagttcgatcatttcggtgagttcttcacggctaatctgaacttgattattgaacatttttattgttttgcgttgtttgatgacatcaataagttgcataacatctcctttttaatttgcccaagcctctggggtgaggcgtttgccaaaatggctttcgattaaacgtattgtgattgggtgttgagggttcaatagcacttctttggtactgccatattcgaccacttcaccttgatccattaccatcaatttatctgcgatatgcttaatcataccgagattctgtccaacatagatataggataatcctaaacgttcctgtaaatttaacattaggttagttaattgtgttttcaccgaaaagtctaaggcactgagtgtgtcgtcaataatgataatttcaggattgagaatcaacgctcttgctaatgcaatccgctgtttttggctacttgatgcctcttttatatgaatcaaggcgtgttcaggatacaaaccaactaattttaaggttttaaatatccgttcgttacgtttttcttcagaaagatgggtagcaagtttcagtggcgaatccaaaatctgcccgatattataattgggatcaaaggcatcatttggatcttggaaaatcattctgatcttcttcgctcgaaaagcgtagtcaccgtaggtcaattcgtgatctttgaaaaacattttgcccgacgttggttcagtaatacctacgagcattttggctaaggtggatttccccgctccgttcgccccgataatcgcaagggtttcttggtgatataagctaaaggaaacattttttaccgcataaaaatcttgcttacggaaaatgccaatgcgatcagtaaagcgtttactgacggactgaatatcaagaagtggaagtgccatagttattttgaaaggctaagaaataatcccttcccccgtttacggggtaaggttagggtggggggaattacaacgatgttacaaaattttcgtttaaattaattgcccccttccgccttcggcaccttcccccgtaaacgggggaagggaaacgaaaagctatatttaaaaattacaatacatctacacaatttaagtcaatgaaagattgctctaagcgtttagacatagactcttccattttgcgtaaccaaacgcgtggatcgtagtattttttgtttggtgaatcagggccttctgggttacctaattgaccttgcaagtaatctttgtttgtattgtagtaatctaaaatacccgcccaagatgcccattgtgtatctgtgtcgatattcattttgattgcaccgtagccaattgcttcacggatctcttcttgtgaagaacctgaaccgccgtggaatacgaagtcgattgatttcgcaggtaagccacgctctttagatacgaactcttgtgatgcacctaagatagatggttttaattttacgttacctggtttgtaaacaccgtgtacgttaccgaacgctgctgcaacagtgaaacgtggacttactgggtttaatgaatcgtaaacgaataacacatcttctggttgtgtatataaacgtgactcatcaacatcgctgttatctacgccatcttcttcaccaccagtgataccgatttcgatttcaagggtcataccgattttgctcatacgctctaagtattttttgcaaatttccatattttcttcgattggctcttctgaaaggtcaatcatatgtgaagagaataatggacgacctgtttcagcgaagtgtttttcacctgcgtctaacataccgtcaatccacggaagtaattttttcgcagcgtggtctgtgtgaagaataacgggcacaccgtactctttcgctaattcgtgaacgtgttttgcacctgcaactgcacctaatacatctgcacgagcaccacttgctggtttgatacctttaccagcatagaattgtgcaccaccgtttgagaattgcacgataactggtgctttaacgcgtgctgcagtctctaatactgcgtttactgagtctgaacctacgcagtttaccgcaggaagtgcgaagttgtgttcttttgcataagcaaagattttttgtacgtcatcacctgttacaacacctggttttacgatgtctaataattttgccattttgatttaccctcaataattcacaatttgtagggacacactgcgtgtgtccgtcaggatttaagtagcggacacacgcagtgtgtccctacgagaatgtttaattaaccgtttgcacgtttctctaaaatttcaaccgctggtaagattttgccttctacgaactctaagaacgcaccgccacctgttgagatgtaagagattttatctgcgataccaaacatatcaattgctgctaatgtgtcaccgccacctgcgattgagaatgcaccgtttgctgtcgcatcaacgatagcttgagcaaccacttctgtacctttacggaagttagggaactcaaatacaccaactgggccattccaaaggatggttttcgcattgcggataatttctgctaactcttctgctgatttatcgccaatatcaaagattgattcttctgcagctacttcgtttactgctttgtgcgttgccgcagcagcgtcagagaactctaaaccaacacgcacatcaactggcacaggaatgtttgttgctttagataagagttgtgcttcaggaattaaatccgcttcgtataatgatttacctacattgtgaccttctgccgcaatgaatgtatttgcgataccaccgcccacgattaattggtccgcgatttttgaaaggctgtctaatacagtcaatttagttgaaacttttgaaccacctacaattgcaagcattggacgttgtggttcttttaatgctttacctaaagcatctaattctgctgcaagtaatgggcctgcacaggcaactggtgcgtattctgccacgccgtaagttgaaccttctgcacggtgcgcggtaccgaatgcatccattacaaatacatcacaaagtgttgcatattttttcgctaactcaggatcatttttcttctcacctttgttaatacgcacgttttcaagcaccacgatttcgttttcttttacatcaacgccatctaagtaatcacgcactaaacgaacaggaacacctaaatctgaagcatttaaataatcaaccacaggttgtaaagagtttgcttcttcaaatacgccttcggttggacgacctaagtgcgacgtcaccatcactttagcccctttttgtaaggctaattttaaggttgggattgttgcacggatacgagcgtctgatgtgactttgccatctttaactggcacgttaaggtctgcacgaatgaaaaggcgtttgcctgctaggtcaagatctgccattttttttacggacatagttagttcctcttttgattttcaaaaataaaaaacggggcgattatatcagtttcaattatattttgggtaatgtagatcaaattattcgttgatattatgaatttcttcataaaataaaataattatgttctttggtatgatctatttagaaacattcaaacccaagcaaatactatctattctttaatatgcaaaaagcggtcgtaaaacgaccgcttataagagagtaagatgattataaccagaagagataacctaccgttgcaatcacaaaaatacagataatgttcagccagaaaccagctttcaccatctcactctgtttaatttgccctgtaccaaatacaatcgcatttggcggtgttgcaactggtaacataaaggcacaagacgcacctaagccgataattaatgcaagccctactggcggcatatttaaggcttgagcaatagaaataaagattggtactaataatgcagcacttgctgtattagaggtaaattctgttaagaaaataatgaatgcggcaaccagtaatccgataaggtagaagtgtccgccttcaattaagaatacgataccatctgccattactttactagcccctgtttgacctagcactgagcttaaggttaaaccaccaccgaaaagcattaataccccccattcggtatttttctgaatatcgtcccacgaagcaactctagtgatacaaattaagactgcagcaaaaagagcaacgatactgtcgaaactaccaattttaccttgtagccctaataagccagaaattagtgggttaattttatcgccaaatacccaacaaattgcgataacgccaaagatagaaagggtaataatacgctcgcgatttaactcaattttttcaaaactatgctcaaaagtaacatcaaatttcggtttaaataccacatatagcgttgcgatcattaatggcatcaagataaacataatcggcaagccatattttaaccaatctgcaaaagttaaattcagctgtgatgccacaatcgcatttggtggactaccaaccaacgtccccattccaccaatacttgcactataagcaatccctaataatacaaagacataggtgttgtggtgagtttctttatctaatttacttaaaatccccattgcaagcggtaacatcattgctgcggttgctgtattactcatccacattgaaagaaatgcagtaacagagaataggtaaatcaccgcaacggataattttccttttgccattgccataattttatttgcaatcaggcgatcaagctgttgaatgtgtaatgctgtagctaaagcaaaaccaccaaagaaaaggaagatagttggatcagcaaaagcacttaaggcttctttagattttactacccctagaccaatcgccagaacaggcacaagtagagccgttactgtaacgtgtagagcttccgtaagccataaaactgcaacaaatactaataaggctaaacctttacttacagtgggttcaaaaggtaatgtatttaataagacaaagaataaaacaatatcaaataacagaataagtccattccttgttattgggtttgatgattgatgtgataccgacataaagcccccacaaaataaaatgatgtagatcaataaaccagattagtttatcaaaacagtaatttattaaaataagcaaatgttggatttgtgagttatatcacaattttttaacaaaaagaaaggtaggctcttgcctaccttagaaaagattatttggtatattaccgcttgttactgagttgatcttctctcgcttgctcttttttcaccaactgcaacgtctgacgaatttcacgtttactttgccaaactaacagaccgacagaaagaaaagtaattccataagagagccatacatagaagccgtaaccgcccattgagaaaaaatcactgagtgatgcaaattgaaaggtcatattttctcctatttacttaattttgcgagttcacgcacccaagggcgtttgcgttcatcttgaagtaatgcactgcgataacgcacaatgcttaaccaaatcataaagatcattgagccaaaaatcgccaataataatgggattaacatttcggttgccattgaaggcttatcaaatttagtgatggttgccccttggtgtagcgtgttccaccattccacagagaagtggataatcggtaagttgattacgcctaccattgaaagtacaccagccgcttttgcacccgtatttttatcttggaaagcagaatagagtgccattacgccaagatagagaaaaaatagtactaaggcagaggttaaacgtgcgtcccatacccaccaagttccccacatcggtttgccccaaattgctcctgtcacaagagaaagaaaggcaaagaccattccaattggtgccattgagatcattgctagatgtgcttggcgaatttgccataccgctgcaataagtgcagcaactgccattgagccataaacacccatcgaccaaattgccgctggaacgtgaatgaaaataatgcgatagctatcgccttgttgataatcttttggggcgaatgccaaaccaataataaatgctgctgaaagcaataaaaaacttaagactgcaagccaaggctgtaccttccctagcaagtggtactgtgtttcagactttgcgtaagggtgtaaccatttccacataaaaactccaagttattacaaaaaatagggttcaaattaccgcttgttactgtaaactaacccttaatgcccctgcgattgcaaaaggcgaaaaggttaatgcgagggctaacattgcccctaaaatagccaattgccctgtatatcccatatttaaggttgaggcttctaacacggcggcagcgaagatcaatacaggtagaaagagcggtaagatcaataaactgagtagcgtaccaccttttctcaaccccaccgttaaagcaaccccgattgcgccaagacaacttaaaatcggtgtgcctaacaatagggttaaaaccaacgcccaccagacttctgtttcaagggaaagtaaaaccgccgtaatcggtgaaagcagaattaaaggcaaacctgttaatagccagtgggcaatcactttcgctaacgccacttgtggcaatccgacgggtagcaacatcaactgttctaatgagccgtctaaataatcatcacgaaatagtcgctcaaaagagagaagagcggaaagcaccgctgcaacccaagctgttccagaggctattttagcgagtaactcaggattagggcccattaaaagcggaaacattgtgataataatcaagaaaaaccataaagggtttaaaatttccgcaggtttacgaaaggctatggttaattctcgttggataatagtcagtaaaatcatagggttattttatactttaaatggatctaacgataacaattgaactttgtcactttctgcggtttgatggctggtaaaaatcaccattcccccttgctcacaatgttgctcgatatgggcgatcagttccgccaccccttttttatcaatggcagtaaaaggctcatctaaaatccataacgtcgctttagtcagccataattttgctaatgccactcgacgttgttgccctgccgacaaatgcgaacaaggcaaatcctctcgcccaattaacgatacttttcctaaggcattccaaagggcttcatcatctaaaggcaatccctgaattttttggaaaaaacgcaaattttcccaagcggtcagttcaggcttaactcctgcgtgatgccctaagtaaaagagattagcgtagtattgatctcgttgttgctggattttaattccattccactgcacctcgccttctgccgccaccgcaagcccagctaaaatccgcaatagactggtttttccgataccgttatgcccttcaatttgccaccattgaccacttgaaatagttaatgaacagccttcaaataaacgagtttcaccacgatcacaggcaatattaatgagcgaaagttgatccatttaaagtcctaaaatttctttgacaaaaggaagtgtaagcttacgttgagcctgtaatgaagcgtgatctaacaacgtcaatttatgcattagggcttgtaaatcacgatctaaccgcttgagcaggaagtttgccacttcatctgaaagctctaaccctttattgcgtgcattacgttgcaaaataatacgtttctgctcatcatcaagatccgccaaacgatacacctcgccccaagttaagcgagaacgcaggtcaggcaagcgaattgctaattgatgaggcggacaatcggcactgattaacaataatgttttcttaccttgattaaacaacccttgctgttcacgtatctgattaaacagatcaaaaatagccaattcccactcttcatcacctgccaccgcttgtatatcatcaagacaaaccacatcaagttgatccgcattatccaataccgtaggggcgaagtaatgggatttatccaacggaatataggttgctgattgttgattaagcaaataatgattactcaccgccttgagtaaatggctcttgccactgctcttaccgccccagatataaaaaaaaggttgctgaacatctacaaaattttggcgtagcgaacccaacagcaataaactgttttcggcgtaaaagttgtcgaaagtatcatcattaatttgatggatcggtaatgtcagttgcaatgtgttatctaagaaaaaatttttgcaaagaatagcggaaaaatgaaaggttgagaagtctcaacctttgatttataagagattttatttattaggctttttgtagttttgtccagttataatatccataaagggaatttaataaatatgcagaatacattatgtacattgatggattttctgcccaaagaatgatagagagaatatttaaggcaatccatagtagccactgttcacgataacgtagtaacattaatgcttgagccgcaaccacaataattgtagttaaaccatctaaacctgtcgaactgccaccagcggccttcaaggcttgaactaataataatgttccaatgaccataaaagttaataatccagtccatcctttaatagttaatgcttttgtgatcaccgcctcacttccttcggctttttgcatattttgtttccaaaggaaatagcctataaattgcgcagggatataaacatagagcgttgtattcatttcaccaaggaaatttgcaccccatgcaacgtagaaatagctgtatgcaaaaattaaaccgaagaaataattgctgatttttcctttactaacaaaaacattacagataatacctgaaatacctgccaccattccaatgatagaatcggggtagtaaatatatacgccaatttgagctgcaataaataagaaaagccaagctacctcaaagggtttccagccactaaaaaattcttcttttaattggtttataagtattggataattcataatgactcctagctagaatatagtctgatttcttgtattctatctaaattttgtaagaaatgtataacataaattatatttctgagaactagctcacaaaatttactattcaacctaatctctctaaattattagaatgtatattattcactaaattgcatttgatatagctgtttataagcaccacctttttccagcaagactttgtgtgatcctcgttcgataatatctccctgatccaccactaaaatctcatcggcgttttcaatggtagacaaacggtgagcaatcactaaaacagtgcgatctttttgtagttcatcaagggctgcttgaattgcacgctctgattcggtatctaacgctgaagtagcttcatctaagactaaaacaggcgaatttcttaataaggcacgggcaatcgccaaacgctgacgctgtccaccagatagacttaccccgttttcaccaattactgtatccaagccttgtggcattttttcgataaattccatcgcataagcggctttagctgcagcttcgatctgctcacgactgtatttgtctttagctgcataggcaatgttattcgcaatggtgtcgttaaatagatgaacctgttgagaaacaattgcacactgttcacgcaaattgtttaaagtatactcttgaattttatgatcatcaagataaatattgcccgaatcaatttcataaaaacgggtaatcaaattcgcaatggtcgatttccctgagcctgaacgcccaactaacgctaaggttttccctgcaggtaaattaaacgagatattttttaaagcgggttgttctttaccaaaataagtaaaggtaacgttttcaaaacgaatgtcgcctttggctcgttcaatttgataagtgccttcatttttttctgttggtaaatcaaataaggtaaagagcgtttggcttgccgccattcctcgttggaactgggcattaacgttggttaaagtttttaatggacgtagaattcccatcaacgcccctataaccgcagcaaattcccctgccgttaaatcatcaccaataatttcaggcgaacctgcgacaaaaagcaccaccgctaaggctagagaagcgatcacttgaataatcggatcggcaatcgcacttgctgccatcattttcattcctttgcgacgcatatcgttactggtatggttgaagcgttcttcttcgactttctgtccgccaaacgataacaccactttatgtccacgcaacatctgttcggcactttcggtcatgcttcccatagattcttgcatattacggctgagtttacgaaagcgttttgacacaactcggattaataccgcaatcacagggccaatgatgaaaagaacaagggataaacgccagctataataaaacattgttgtgacgagaaagacaatgtagatcccttctcggatcacgctttgcaacgcatttgccgaagaacttgctacttgctcagaatcataggtaatacgggaaagtaatcttcctgaagagttttggtcaaaaaatgttacaggcataaacattaaatgcttaaatactttttgacgcattgtcatcacaactttaccagacacccacgccaaacagtaggcagaaataaagctggtgataccacgagcaaaaattaagcctacgacaataaatgccatcacttttaaaaagttacgatcagagtcaacgccaaagccttcatcaatcaaaggtttaagcattgtgatcaagtatgcatcggcagcagcgttaaatatcattgccaccattgccacaataatccctattttaaaaagggaaatcataggccataggcgtttaaatgtctgccaagtagagtggtcttgagttatatcatcaagagaaaaaggatttttatttgccattttttatactttctgatcaatcatagtttcccattctaaaactaaatgttcattctgccaaatattcatttcaaagaaaaaatcagatagaattattaaagagacatatttttatctatgcttacaaaagcacaatcaaatctagtttttgaaaggattatatttccttactattttatgatggcttaatagccctcttcacttctaaggattttttatgctacatctactcaaaggggcttatcgtctatttcgttgtattcgagaatttgtgataagtctggtatttattttatttgtgatgttagggtttgcttttatggcgttatggtcaagtgatgctgctaacagcaaaacacctgtcgaatttagtaaaggggctttattactcaatttagatggttatttagcggataatcacgatgaatttagtgattttaatcgctttttacgttctgaattaggtggttcaaatgagccgattaaaatatcaacttttgatgtagtgcgtgcaataaagaaagcacagtatgatgaaaaaattacaggattagtgcttgatttaagttattttgaagggggcgatattccttctttaacctttgtaggcaaagagattgagcgttttaaacaatcaaataaacctgtgattgcaattggtgaaggatatagccaacaacaatattacattgcgagttatgcggataaaatttatctaaacaaagcaggatttgttgatttacacggtttaaattattccactctctatttcaagtcgttgctagacaagattgaagtcgttccgcatattttccgtgttggaacctataagtctgccgttgaaccgtttttgcgtgatgatatgtcggcagaagctcgtcaaaatgctcaattatggctatctcaattatgggcaaatttcagcaatgtgattgctaaaaatcgccagattgatgcaaatacaatagtgccagaagcaaaccgtttaatcgctcaatataaagcagtgaaaggtgatgatgctcaatatgccttaatgcaaaaatgggtgacggacgtggcaacacatcgtcaaattcgtctcgacttgattgagcaatttggtgaagatcaagacggaaactataaccatatcgacttttttgactattctttgtcgttatctgaccgctttaatgtggtaggcaaggataaaatcgctattgtgaatgttgaaggggcgattgtgttaggggaaagcgatgatgaagttgctggcagtgatacgattgtaaaattgctgagaaaagctcgcgaagatgatgaagtgcgaggcgtagtgttgcggattaatagccctggtggaagtgcgatggcatcggaattaattcgccaagaggttgaagatttgcaacaagtggggaaacctgttgttgcatcaatgggcggaatggctgcttctggtggttactggattgcggcaacaagcgataaaatcattgcaagcccaacaactttgacaggctctatcggtatttttggtttagctgtcagttttgagaaaaccgcaaaaaaacttggtgtgagtgaagatggtgttagtacatcgccttttgcaaaacaaaccgcattaaaaccgttatcaaaagagcaaagtgagttaattcaaattagtattgaaaatggctacaaccgtttccttgagttagttagcaaggggcgaaaaatgtcgaaaggtgatgtagataaagtggctcaagggcaagtgtggcttggagaaagtgcctttgaaaaagggcttgttgatgagttgggtgattttgatgatgcttatcacgctttaacaatcttaatcaatgaaaaacgtaaaacgaaaggagaagcggaaattgaacgttttagcacacaatggttaattgatgaaagtgatgatttgatgagccaagtaatgcgtgatttcaaattgcaattacaattaaaagctgttgaatggttgaatttgcctttgcctcaacaaactcagcaacagcttggtatgttggcaagatttaatgatcctaagcagagttatctctactgtttaaattgtggtagtgtgaagtagttgaacgaacgagacaaatagcgttcgtatactctagctaatttagggaaattcactttgattaatgaattgaggattgcaaaacaagctatacctctttaaacttctcacctaatttttatatagaaaaagcaatgacaatgacagaaacaatgacactttctttaggacaacagctaaaaaatgctcgtgaagcattaaatctgacgattgaggatgtagctcgaaaaacaaatctgaaaaaaatccaccttgaagcgatagaaaatgatatttttattttgccaagcgtgccgccagctttcgtgcgtggttatgtgcgtaattatgtacgttttctgcgtttgcctgaaacacttgtaaattcagtgaattacggcgaagtgacaattccaaaagaggtccgaaaagcagcacctattgcagttaaaaaccataagtcgcaaatgcgttgggtaaaagggctgacgtggattgtgttgttaagtgcagtagggatgacgttagcttggtggtggcaagagcatcagaaagatcaggctaaccgtgagcagttgattgtgaacaccactgaagcaacagctaaagttgccgaagagcctcaacaagcggtaacattgcctgctgaaaatgcagtgccagcaacacctgcaacagtagcagaaagcagcacccctgttgctgtagagcaagctgagccagttcaatctgttcaaactgagcctgtgcttatacaaacagaagttacgcctcctgttcaaacaggtagctcaagaatttcaatggttatttcgcctaattcaggaaatgttacaccacaagtttcgacagaaatagctgtaccaactcaaactgagcagccacttaatattctgcaagcaactcaaacagaagcaagcaatcaagcggaagaaccagcacaaacggcggtagaggaagagctgagaattgagattacgggtgctgaaagctggattactgtgcgtactgcacaaaataaacgattagcagaaagactttataaggcaggtgaagtactaagttttaacgataacgaacaatatcgtttaactgtgggtgcgcctgctaatgtcaaaatttattacaaagggcaagttgttccattgaaagtagatggacgagttgcacgtttcaaattacctttagcggaataatatgttaaaagaaccacctattaagcgtcgtcaatcgaccaaaatttatgtcggtaatgtgcctgtggggggcgatgcaccgattgctgttcaatcaatgacgaacacaagaaccacagatgtggaagcgactgtggcacaaattaaagctcttgagcgcgttggggcggatattgtgcgtgtgtctgtgccaacaatggacgcagctgaagcctttaaattgataaaacagcaggtaaacgtaccgcttgtggcggatattcattttgactaccgtattgcgttgaaagtggcggaatatggcgtggattgcttgcgtatcaatccaggtaatatcggcaaagaagagcgtattcgtgcagtggtggattgtgcgagagataaaaatattccgattcgtatcggggtgaatgcaggctctcttgaaaaagatattcaagagaaattcggcgagccaacgccagaagctttgttagagtcagcacttcgtcatgttgagatcttagatcgccttaatttcgatcaatttaaagtgagtgtgaaagcgtcagatgtctttttagcggtcgaatcttaccgcttgttagctaaagcgatcaaacagccgatccatttaggtattacggaagctggtggcgcaagagcaggggctgtgaaatcagcaatcggtttaggtttattactttcagaagggatcggagatacgcttcgtgtttcattagccgcagatcctgttgaagagatcaaagtgggctttgatattctaaaatccttgcgtatccgttctcgtgggatcaactttatcgcttgcccaacttgctctcgtcaagagtttgatgtgatcggcacggtcaatgcccttgaacaacgtttagaagatattattacaccgatggacgtgtccattatcggctgtgtggtgaatggtccaggtgaagcgttagtgtcagatcttggcgtgacaggctcaaataaaatgagcggtttttatcttgatggcgttcgtcagaaagagcgttttgacaatgataaattgatcgaccagctcgaagcgaaaattcgagcaagagtggcagaacagcataatcgcattgatattactcaaatttaatttttatttttagaaaagcacaatgaaagtcgcggtttttagtaccaaaagttatgatcgaaaatatctcgaaatagctaatcaacaataccattttgagtttgaattttttgattttatgttgaatgaacagaccgtaaaaatggctgaaggctgtgaatcggtttgtattttcgtgaatgatgatggtagccgtaaagtccttgagaaattagctgaacaaggaacaaaaatggtggctttacgttgtgcaggctttataatgtagatctacaagccgcagaggaacttggtattcaagtggttcgcgtaccagcgtattcacctgaagctgtggctcaacataccgttggcttaatgatgacattaaaccaccgtattcatcgagcttatcagcgtacccgtgaagcaaacttctctcttgaagggctaatcggatttaatatgtacaaacgtaccgttggggtgattggcacagggaaaattggtattgcaacaacgcgaattttaaaaggctttggaatgaatattcttgcctttgacccatttaaaaatcctgttgtggaagaaattggggcaaaatatgtcacacttgatgaactttatgctaagtccgatgcgataaccctacattgcccagctacgccagagaactatcatctgttgaataaaaagacttttgacaaaatgaaagacggcgtgatgatcatcaataccagccgtggttcattaattgatactcctgaagcgattgaagcattaaaacgtcgtaaaatcggtgcgttaggtatggacgtttttatgaaaacgaacgtgatcttttctttgaagataaatcaaatgaagtgattttagatgatcttttccgccgtttgtcttcttgccataacgtgcttttaacagggcatcaagcatttttaacagaagaagcattgatgaatatctcagatgtgacactgtataatatctgctgtttacaaaaagggggacgctgcaaaaatcaaattgaatagaaatagaatacaaaataattgagaataaatatttctaacaactgtttgtctattactcctaatcttaatggctgcttaaaaaggataaatttctctagtatcccaatgctttaaaattgggtaaaaaattgttgttatctaaacgctttaccacagtatcaataaagccatcaatatttaaacaaagctcacgccacccttgaggaatcgcatctaatgtgaaatcattacaatgtggtttgaattgtatacacgttgagggcgttgataatatacgatacccattccattgagcatcaacctcttgatgaatatgcccatgtacaatagccttcactttcggaaaagcttttaatgtagcaagtagatcatttacattagaaaggctatgctgatcaagccatgctgaatttgttggcagaatattatggtgtaaaacaattaaagaatatcgttcaggatggacttccaactttctttttaaaaaagcaagctcagaaaactctaatctacctttagggctatcttgaatatggctatcaagaagaattatctgccaatgatcaccaactaaaatatgcttttcaggtttaatttgagaataaatagacaaagcattacgcatctgtggttgtaaatcatgatttccagctacccagaagagtggtttaaccaacggtttaaccatttttgcaaaacgatgatatgcctctcgattatggtcttgaacaagatcgcctgttgcaagaatcaagtcatactcaaatgattctttcatgatcatattaagcacagcttgaaaactttgagtggtattaacccctaatagttcacaagtatctgatgcaaataaatgtgaatcggtaatttgtaaaatccgaattattggggagcttaagggaaatatataactatcgtccataatactaaaggttcaaagaaaagccataagatggataggcaactactctactgatttcccaaacgttgtcatcaagaaaaatagaaaaatgtgacatctcctgcacttttcacaaaaatttacattgcttaataattttttgcaactctaatatattacatatatgtcaataatgattaatcagaactagtgttagttaaaattagttcaaaaaactatcaaaaattaactcataattatccccatccctattataagaaatataacggggaaatttttcacctgaaaatttcttcactataatctgtttagcacccgttttgaatctgtaagttatttcctcaacatctatttctcctattctaagaatagctctagattcatttacaatcgtatccttatgtggataaagttttttaccatttgtcgtttgaaaattatacggtaatactccataatagctgagttgaaatgcaatagaaaataaatcaaacgttggtaaagttaagatctcctgtttaagtggttctactactttcccatattgaattattgttcccttaacctctgccttagcataagttttcccatttcttatatcttggtaattcaacatattaaattgtttaccttgtattttaccacctgtattaaatactatattatataaaggaatgttaattttagatattattgaataatattcatcactctttttaaaatggatatatgttggcattatataattagacttatacttgatatgaaactcttctgcccttatagattgaacaatacaaataaaagaaataattaatactcctaatttttttaattcattcattaaatttcctctaaactaacgtactcaaaaagtctagcaatcgcattattatcacgaagttgctcagcttcttcaacttttattctagttaaatgagcagaaaaataattgataaaatcatacatataattacgtaaaaaagcacctcgcttaaaagctatttgtgtcatactagattgaaaaagatggcttgcatcaatagcaactaaatctttgtcttccttcgtatatgccatagttgccataattccaatacctaagccagaacgaacataggtcttaataacatcagcatcagtagctgtaaatactattctaggtagaataccatgtttattaaaagccttatccagatctgagcgccccgtaaaaccaaatgtataagtgattaaatcatattgtcccaactcttcaatagttaatttattatttcgcttatttagcttggccaaaggatgatctggttttacaatcactgaacgattccacatgtaacaaggtaacagaataacattttcaaaaagatattgagcctctgtaataatagctaaatcaacctctcctgccattaatgcatcatatatttgtgttggagatccttgatgaagatgtaaacttacggaggggtatttattcttaaatttttcaattatctttggtaatacgtaacgagcttgggtatttgtagttgcaattctgagtattcccttatgcggacttgtttgctcttctgcaatagatttaatcccttgggcttgtgccaacatctcccgagcaattgtaataatacgttcccccgccggagtaagcgctttaatatgttttccacatcgttcaaaaatatgtatacctaattcatcttctaacaaacggacttgcttactaattccaggctgagatgtataaagtacctcagcagcttctgtaatattcatattttgattaacgatttcaacaatatagcgtaactgctgtaatttcacgtatatatcctttatttctaacttagtacaatattaagtaattgctttaaatccgtaatttcataagttggcttaatttctgtatgattaacttccttgcaagggttaaaccagcaagaatcaatacctatttgatttgcacctaaaatatcagaagaaagagtatctcctaccatcaatattctagacttatttatatctcccatttgttgaaaagcaaacttaaaaattctttcatctggctttggcacccctgcaacctccgaactaatcacaatatcaaaatacttttctgtattagtattttccagacgcttcttttgcaagatttctaaaccatttgtaataatccccattctaattattccaaacaatttttctaatacctctgtagttccagataatggtttacttattacagccatttttaacattaattcattatttaaagctaattcgtcttttccaattttttttgcaatgttagagaatcgacatatttgaagctgttcaattgtgatttcttgattttgatatgcaagccacaagggcttattcacagcttgaaaagcttcataatcatcttgggcaaactctataccataacaagctaaaactgcttgtaaacctaaatatgaattaaatgaaaataacgtttcatccgcatcaaataaaatccactgatacttcatattttctcttgagttattatactactcagatatattaatttctttcgtaatccaatcaacaaaatgctgtactttaggattgtctgatatttgagatggataaacaacataaaatgatttttcatcacttaatcctgtagaaaaaggctcaattaaatttccttgttctaattcatgctgagcaatagtcttgttggcaatagcaataccttgctgatacaaagctgcttgtaatgccataaatgtatgactaaaaattggaccaatttcctcaacatcaatttgttcacttaaaccaaaatattcaatcgttcgcttccatttattacggctaaatacatgcaataatgtttttccaatcagatcttttggtgattttaacggattttcctctaagaacttaggagaagctaaaattactaatggagcttctgttaagcgaatagattccacattctcccatttacctgaaccataataaatagcaacatcaatttcttttccaagctgagcctcatcttgatctacacctttaatcctgacctcaatatgggggaactgctcatgaaacttactcaaccgaggaacaagccaatgcataccaaaagtttgaggcacactaattgtaagaatttgtctattatttttagaacgaattttatccgttgctttagcaatttgctctaatagcgggcgaatttcatcaaaatattgcaaaccaagttccgttaattctaacaccctatttttccgatgaaaaagttgaatatttaaaaaatcttcaagtaatttaatctgatggctaactgcggcctgggtaacaaatagctcatctgcagctttcgtaaaattaagatgacgagcagcagattcaaatgccttgagagcattgagtggcggtaactttttattgttcataatttttactagaaaaagtgagtttttttagattactttttttgataaataaaattaaaaaatctcgtttgtataactggtcaaacatctctaaaattcagcaccatacttagatggatagtgatagctgtcttttagctatttttgaattttaagtatgatgttgtgtttgcatattggtctaggaaactagactagagtaacaaaaaagttactcgtttcacttcctgtatattttgaaccttttggtttagctaccgcccatgttgggcggtttttttatagcagaatttcctactattctaccagaatatacaaaaattgccacccaaagcctcactttcgatcagggcaagatcgcatctttctcaaatttatgatctaatacaccttaattatccatatcaaatcaggttgtaaaatgagcgtttttcgtttttttgaaaatttatccgacccacgagcctataatcaaaaacaccactttttagacatcgtttttctcgtcgtcagtgccgtgatttcgggggcaaacagctggactgaaatcaaactttttggcgaattacatttggattggttgcgaaaatatcgtccttttgagtgtggcattcctgtcgatgatactatcgctcgtgtaataaaacgtattgagccacaagcgtttaatgaggtttttcttaattttatcaatgagatacgcacacaacaaggacgtgaagtgattgcgattgatggcaagacgcttcgtcatagtttcaatccggaaacccaaagtgctttgcacagtgtaacagtgtggagccagtctcgtggtttgattttgtcgcagaaaaaatcctcgggtaagcaaaatgagcagcaggcggtgatggaaattatcgatagtttttgcttaaaaaatgccgttataacggtggatgcgatgaatacacagaagaaaattgccgagaaaatcatcgaaaagaaaggggattatgtgatgccgttgaagaaaaatcaccgtcaatttcagtcggaagtggaggcgtattttcacaaaatcagccgagattgccccgaaatgcttgagacgtttgaggaggtaaatgcggaacgtcgtcgaattgatgagcgttactaccgtaagctgaaagtgagtgattggctgagcaaagcggaggaatggaaggggataaaatcggtgttggaggtgtgtcgcaagcggtcagataatggcaaagaatcgcaagaaaaagtcttttatatcagtagtttggatgttgatattcaaatattggcgaagtgcgtgcgagggcattgggaagtggaaaacaaagcccattgggtgctagatgtggtctataaagaagacgaatgtgctgtgaccgatgaatgaatggggtgcggaaaatctggcaatcttgcgtcgattagcgttgaacttggctcgattacacccgaaaaagcagagtatgaaagggaaattgaccgcacttttataggattaaaaacgaatgacattatcaaccaaataaaaacaatttcttaaaagcctcgcccaccaccttaatccggtagtcatgctaggtggaaacggtttaactgaacgagtgttagcggaaattgaaattgcgctaaatcatcacgaactcattaaagtgaaaatcgctggtgccgatcgcgaaaccaaacaattaattattgatgccattgtgcgcgaaacccgcgcggaagcggtacaagccattgggcatattttggtgttataccgtccaagcgaagaacaaaaaatccaattactgcgcaaataagtcgatcttgaggtgcgccaaacgcaccttaaaatcacgcaaaaaacgaccgcacttttattcgccatgttaaaacctcctaccagcccaaaataccaagattttttatgcaaaaacgcatacaatgcatttcaatttgcgccttgccgaaaatcttgctaaattgcggtacaatttggtgcgaatttaatattaggaagaacaaatgagccaagaatacttagattttgaattacctattgcagaactggaagccaaaattgaatcgctacgttctgtcgccgaacaagacgataaaattaatcttgatgatgaaattgcacgcttgcaaaagaaaagtgtggaattaacacaaaaaacctttgcaaatttagacgcttggcaagtttcccgcatggcgcgtcatccaaaccgcccttacaccttggattacattgaacacatttttaccgattttgaagaacttgccggcgatcgagcctttgctgatgataaagcgattatcggcggcttagcgcgtttagacggaaaaccggtgatggctatcgggcatcaaaaaggacgttcagtcaaagaaaaagtaaaacgtaatttcggtatgccagcgccggaaggttatcgtaaggcattgcgtttaatgcaaatggctgaacgctttaaattaccaattatcacctttatcgacaccccgggagcttatccgggcgtgggggcggaagaacgcggtcaatcggaagctattgcgcgtaatctacgtgaaatgtccaccttaaaagtccttgtgatttgtaccgttatcggcgaaggtggctccggtagcgcgttagccattggcgtgggtgacaaagttaatatgttgcaatacagcacttattccgtgatttcaccagaaggttgcgcctctattttatggaaaagcgcggacaaagcctccaccgccgctgaagtgatgggtttaaccgccaaccgtttacacgaattgaaattaattgacaatattgtgccagaacccttgggtggtgcgcaccgtaattatgccgaaatggcagcccatttaaaacaacgtttattggacgatttagccgatcttgaagtacttgatcaagaaaccttattaaatcgtcgctaccaacgtttgatgagctacggttactgttaatcaaatgatttgttaaaaagagctgttattttgaccgctcttttgacgttataaaaaagatatttattattaaaaaggagttcatatgaaaaacctgatttctattcaatctcacgtcgtgtatggttatgcgggtaataaatccgcaacctttccaatgcaacttctcggggtggatgtatgggctttgaataccgtccaattctccaaccatacgcaatatgccaaatggaccggtatggtgctacccaaagaacaaatcggcgaaatcgtgcgtggtattgatgaaattggcgaattacatcgctgcgatgcaatcatttccggctatatcggttcagctgatcaggtcgaagaaattgtcaatgcggttaactatgttaaacaacgcaatccaaatgcggtttacctctgtgatccagttatgggacatccagataaaggttgtatcgtagcagatggtgtaaaagaaggtttggttaaaattgccatgaaagcggcagatattattacaccaaatttagttgaattacgtgaattaagtggtttaactgttgataatttttcccaagcaattgaagcagttaaagtaattctagctcaaggtccaaaaaaagtgttggttaaacatttgagtaaagttggacaagatccgactaaatttgaaatgctactcgctaatcaagaaggcatttggcacattagtcgcccgttacatacttttgctaaagatcccgttggcgtgggcgatttaactgccggattgtttatggcgaatttgttaaacggaaaatccgatattgaagcctttgaacataccgccaatgcagtgaatgaagtgatgcaaataactcatgattccgggctttacgagctacaaattatcgcggctagagaatttatcgttaatccgcgcagccattatcaagcggtaaaaattgcttaatatagcatggatatttttgcaaaatttgagcatatcgttagccaacatcaaccgacacaaacacattttctcgtcggttttagcggtgaacttgattccaccgcattgctctctttattgacaaaattctgtcgaaaacgaccgcacttttccctcagcgccatccatattcatcacggtttaagcccaaatgccgatcattgggtgacacattgtcaacacctttgtcgccaattgtccgttccactgatcgtggaaaaagtccaagtcgatcgacgtttaggagttgaagtgggcgctcgcgaagcgcgttaccaagccattcgtcgttatatgcgtgcagatcatattttgacgaccgcccatcatcagcaagatcaaacagaaaccttttttctcgcactaaaacgtggcagcggcgtgcaaggcttgtccgccatgccgatgcaaagtgcggtcttttctgtgccgatttttcgcccactgctccaattcacgcgtaccgaactggaagaatatgttaatagcgaaaatttgccttggatcgaagatgaaagcaattaagataaccgttatgaccgcaacttcttgcgccatcaaattttgctccccttgcgacaacgctgggcgcattttgaccaagccgtacagcgcagcgcgcaacattgcttagaacagcagcaattgttaaacgaattactggcacaagaattacaaaaatatcaaaaaaatgaccgcacttttgacattagccaatttgtgcatttttctataccaaaacaaaaagcgttactgcgtttgtggttggccaattgcgatttacccatgccctcaagcaaacaattggcacaaattattcaggatgtgatcttcgcccaagccgatcgttatccggaatttaaattgggcgacaagctgattcgtcgctatcgccggcacttacacatcacaccaatttatcaagatatcagccatcttgttttgccgatatgcttaaaccaatccattgatttacccgataatttgggcaaatttataattaaaacgcaatctaatgaatggattgcaaaatggcaagatcacatagttctccttccgccaacacaaaaaactatccatcttgcttttcgttattcgggaacggttctccaccatggtattcatcaagacatcaaaaaactgtgtcaacaacataatgtcccctattggttacgccaacgcacgcctttaattttttatggcgatcaacttcaatgtgtagtggtacactaatcccacagtcctcaataagtggtaaaatttaaccaaacatgaggatataaaaatgcgaagacctataagaacctttagcgcggaatttaaatccgaagcggtaaaattgattaccgagcgtaaatattctattacacaagcttgcaaagagctagacatcggtgaaacagcgttgcgtcgctgggtaagtcaagttcaagctgaatgtcagggctatgtgttgccgggttcaaagccaatcagtcccgaacaacaacgcattcgagagttagaaaaccgtatcaaagagctggaagaggataaagaaattctaaaaaaggctacggcgattttaatgtctctcgagagcaacgataccaagcggtcacgacgttaaaatcgcacggcatcaagcgtttatgtgccttatttggtgtgtcagaaagtgcctattatgcgcgcttgaaacggcgacaagcggtcgaaaaacacaccgcacttgcgattgaaatcaaggtcatttttgaggcaagtcgtcaatccgccggcaagcgaaccgttcaatcaggtttgagacaaaagggaattcgagctagtttgcggttgattcgcaacctaatgattcaacagggattatttagcaaacaaccacaaaaatggcataaccgaaataaagaaatagggcaagtttttgctaatcacttgaaccgagcatttacgcctgatgtacaaacgacggtgctttgtggcgatacgacgtacattaaagttaatggtgtttggtgctatttagcggtagtgattaacctgttaaaccgtcaagttgttggttggaaactgaatcgacaccacgatgcgtaattgattgtcgatgcgttaaatcacgcgatgttgtagactaaacgtacgaaaacaatgctgtttcactcagaccaaggcagtatttatgggagtaagcaatttacccaatgtgtgcaaaactacaagttaacacaaagtatgagccgacggggcaactgctgggataatgcaccgatggaacgttggtttagaagttttaaatatgagtggatgacatatggtggttatgttgattttgaaagtgcggtcaacgatgtaaaagattatgtgatgtactacaaccacattcgcccacatagctataatcaaggtttgcccccgattttagctgaaaaaacttatcggggactgttgaattagttgatcactacaaattgatgagcgttactaccgtaagctgaaagtgagtgattggctgagcaaagcggaggaatggaaggggataaaatcggtgttggaggtgtgtcgcaagcggtcagataatgacaaagaatcgcaagaaaaagtcttttatatcagtagtttggatgttgatattcaaatattggcgaagtgcgtgcgagggcattgggaagtggaaaacaaagcccattgggtgctagatgtggtctataaagaagacgaatgtgctgtgaccgatgaatggggtgcggaaaatctggcaatcttgcgtcgattagcgttgaacttggcacgattacaccggaaaaagcagagtatgaaagggaaattgaccgctgctggttggtcagatgaatttcgagatgagctgttgctcggcgtgtaggttgaaaaatgtacaacatatacgattgccctgtacgatctaaagattagggggcgttttatcttgtttcatcgggtaaaatacgttatctttaaatttatccacccattagaatttattatgcaaattaatgcaatacgcgttacgcaacaagcgaattccactatgcctctaattgaactgaaaaatattacgatgcattttgggcaaaaaactgcattacaacaaattaatatggcaatttaccccaataccgtcactaccattgtcggtcctaatggtggagggaaatcgactctattaaaaattttgctcaaattgctcaaacccactaccagggatgtgatttatagccggaatgttcgcattggctacgtcccacaaaaaatccatttagatcatagtttgccgattaccgtgaaaaacttcctttcccttaagaaaggcatcactgcaaaagacattcaacaagcagcggaattgctttctatctcacaccttatgcacaattcgttgcaaaaactctccggtggtgaaatgcaacgtgtattattggctcgcgcaattttaaatcaacctaatttactggtacttgatgaaccaacccaaggggtcgatatgaatgggcaaattgaactctatcagcttattcatcaaatgcgagaaaaactaaattgcgccgttttaatggtgtctcatgatctccatattgtgatggaggataccaataaagtattgtgcgttaatcaacatatttgttgttccggtacgcctgaagctataagtagcgatccgacttttatccaacattttggtgatcaattttctaaaaatattgctttttacacccatcatcacaatcaccgtcatgatatgcacggcgatgtttattgttcagggcaatatcaatgcgcacaacatcatcattaggaacgctttatcgtgcttgaaatcattcttcctgcttggcttatcggtattttgctctctttcattactgcacctcttggtgcttttgtggtttggcgcaaaatggcctattttggcgacactttggcacattccgcattattaggcgtagcattaggtatttttattgaaattaacccctatctagccattctcattttgacgctatgcattactttattaatggtatggcttgaaaaccatacacaatattcagtagaaggggttaatattcaacgaatgcgatttattttaatgattttgaccgcacttacaattgccttaagcatgaaatttgtgggggcattgattattacctccttgctcattattccggcagccacagcacgccgattcgcacgaacgcctgaaaccatggcgatgattgccgttgtcatcagcatgttagctatcactatggggctggaactttccgccttttataacactgcagcaggtccatctgtagtcatctgttctgcactcttgttcgcactttcttttttgtggaaagaacaaggataaaggcttttctcatattcaaaaaaacaacggacgcaataacaatagctccgttgtagtaatactagaacttgttgatgttttgaggctgtaaaatcaccaataagtgtttatttaatatcccagtatggcagaaccatactgggttacgcataaatcagcccctttggggctgagaattagagtggcaaagccactcaactatgcgtaacctagtacgcattttgtgtgctaggtataaaatagtatattttataagcataaaacatcaacaagccttaaataaaatttcacttttttccgttcttttttacagcaaaactctgtaatttcttgtaaaattaggatagtttttatctcttttctaggaaaagtacttttatattatgagcaaagccattttaactatcgtaaaaggcaataaaacggaatctattgcattgcaacaaggaaaaactgtcatccaaaaaaccgaagcagcggcgcgttatcgtattgttgatgagaacggcatgctaattgagcctatagaagtagaacaaatcggcgacaatttagtcttttctacctcagccaatgaagaaccgcttttggtattggaagaatacaatgcctattattctgttgaaaatcttgcaaccgtagttgaaaacagtgtttctgttaccggaaatatagccgccagctcattaagtgcggtgcaattaaccgctatttctttaggaacggtcgcgaccactattggtgcgataaatagttataatcatagcaaaaccagcaatacgcctcgtgctgaagaaaacacaacgcctaacacaaaaccgtctgtgccggaagtaaaaccggttgaaaccggttgaacctgaaacccaaccaacggaacctgaaccccaaccaactgagccggaaactcagccaacggagcctgaaccccaaccaactgagccggaaactcagccaactgagccggaaactcaatcaactgagccggaaacccagccaactgagcctgaaactcaaccaactgagcctgaaactcaaccaactgagcctgaaactcaaccaacggagccggaaacccagccggttgagcctgaggctatcattgataaagatcccaatgctgcttgggttgttatgcctaaagaaaaagccgcagttgaaccggaaattgaggatgaaccagaagcaaaacctaatactaaaccgcagttagatcctttgcccgaattacccgtattaactgaaccggcagcaggcgcagcacctgttgccgcaattgcatggacaagttatgtgggaggagaggacggtatcattagtcaatctgaagctaatgaaatcataagattatcaggtagttatgatgtcaaaggcacatctaccacgccacccatgattaccgttttagccgatacaattagactggctcaagttgatcctgtgactaaaacttggtgggtcgatattaacgcttccgcattggtggcgaaaggagaaggagagaaagaacttagcgcatctattacagcagttcatgatacaaataaaagattgcgcggtacggctcaagctaaactaaaatacattgttgagacagtgacacaagagcctgaaattacctttgataaaattacgggcgacgatttcttaagtttcgttgaacaaaaattagaaaaaaccacgatttcaggtacggtaaaacacgccaaagatggggatgttgttaagttagaaattggacaatcagtttattatgctgaagtgaaggatagtaaattttctaaagatgtgaatactcaaagtttaattattcacgaaaaagtcaccgcttctattgaaactcaaagtgtaaatggtggaacagctaaaggcagtgcggtaacttatgcgaatgtagaagaaacgcctttaacaattaagatgaatcctgtaacgacagataacatccttaatattgcagaatctcagcaggaaattaccttatcaggctcggtcacacgtgcagatgatggttctgttgttgagctaactattggtgatcaaacgctcaaagcacaagtgcttaatggcgaatttgaagcgaaggttagcggtgaattgttagcgaaaaataatactgttcgggctgtggtcaaaaatacggaaaatatgaccgcgcttgaagtattccaatatgaaacagctttagacaaaccaaccatttcgctacgtcccattactggagacaatgtgatcaatgccgaagaagcagcaaaagaaacgaccgttattgctggaagtgtgacaggcgcaagcgatggggatttggtggaagtgtcttgtggctgcccttattgtgccgcaagcaattggaatacaatccaaactaaggtagtcaatggttcttttaaagtagagtttgccaccgcggttttaacggctgacaaccataaagtcattcgcgctaaagttatcggaaccgataaggccggcaatcatggtgaagccgaaacttcgcaagcttatacggttgcaacgtcaggcagtgatgccaacctgacaaatctctcagctgtaggtgaaaataatattttcaataaagcatttatagaaaagaattctacttttacttatcagggaacagtatggggacatactgtttgtcgtgaagaagatttagtggaaaaagttgaaatcaagctcaatggaaaaacgttttccactaatttaagccgagatggttcagcactacgaaaatttagcaccatattaaatgtcgcggattttgcggatgcggatgaaatgtacgtagtcgcaaccattcgcaataaagaaacaggaaaaattcacgaagtagcagaaaaagtctcctatcgttatgatactgaagccaatattgccgtttcagtcaatgaagtcaatggtggcaaaacgatttctaccgagaatttgaataaaaccagcctcattagtggcacactcacttacgatgaacaagatattaatgccaaagatattcaagttaaagtcaatataaatggcaaagaatatgatgcaacggtatcagataaaaaatggtctttgaacttacccattaatgaaggctcgctgattgaaggaaataatcacttaaaagttaatgtaatagctaaagatgttgcgggtaatacggctaccgcagaaagtgcggtggattttcaagccgatatgacaccgccaatgccaatcattacgcttaacccaattaatgaaaataatgtggtcgctaagactgcgacagattctgtggtattaagtggcaaagtgagtggcgattttgctgttggtgagcaactcaccttaatgtataacggcaaaacccaagcggtggaaattcaacaagatggtgcatttagtttaacgcttccggcagcagaattagcctcttcaaattcactgatagtttctgctgtttataccactaaagatagtgttgggaatgtaggatctgcgcaaagtgatttatcttatagtgttagccaaggcgatatcgctattttgttaaatgatattacggcagataatcatatcaatgtgactgaagccaaagggcatttacaattatcaggtaaaatttttggtacagaggcttcaactacaactcaagttgaattacaaattaacggtaaaacgcacaaggttcaggtagaaagtgatctgagttttaaattggatattgctgccgaagaattaattcaagcaccaaactatgtggttacagctaccgctactgcaggaaatagccgcgcggatacaacgaagaagtttactgttgccgctgaggtagcggcaaaaattgatatcaccgaagtgggcgatttcaccttaagcttggctgaaaaatcacctattgtccgcatatttggtgaagctgaatttgatggtgtttatgcacaaggtaaaaattataacgaagtacgccaagcgatcgttacaattggtaatcaatcatttaaggtcggtgttaataataaaacattctttatagatattgccgccgatgaattaaaagggctaaatggacaacaaatttccgtaaaattcaccccggatccaaaggtttatgagctaactaaggctgatggattttataaaacagcttatattaatgcgcctgaagtcacgactaaaagcgttacgttcacaagcgattatttaaaagtggagaatcaagatcagtattttgttgcgtatcacgaagatattgcaacggtaagtggtgttgtatcaggaactgccaaagggggagatgttgttctcttgaatattggcaataaaacgcttaaaacaacggtaaattcggacttaagtttctctgcgatcgtgtcaaaacaaaccttgagcacagcagagcagatttctgctaccttggaaaccacagatcgttccggtaaagcaattagcgtttttgatcaagaaaattatgcggtagcggcctcagtagatggcacaaaacaaattgggttaattccacgtagcaatcccattcaagatgatcatacaaaagataattggaataccccatatttcttaaaggctgtaggtagcttagataaaaatggctattctgccccattgggtggaacacaagataagccttatgtcattaaatattatttccacggcacggaagagttagaagcgaataaagaattgccttccgatgccttggttgatgaaaacttaaaggcagtcttcagagatgcctatgccatcttatctagttataccaacatacagtttgtggaaagtaaaataagcggtgaccgtgatacttttgtgcattatgcttccatgacgaatggctctgcagcagtcgcaagcaacggtgggcatattacttggaatgcaggtagcagctggaaaggctggggaacggattatctttattacaccgcgcttcacgaaattgagcatacgcttggtatggttcatacggttgcaggtgatattccgacctttaaagaaaacggctatggtaatgaaaataccgcggaattttcgattatttcttatgatcgctatgtcaatgataatttatatttatccttacgcgatttacgcccttatgatttagcttatttacattatcgttttggtgtcaatccaaatgcgcgcgccggcgatgatgtttatagctttgcaaattacaatacctatgcttctgacggcggtcgttatatttgggacggtaacggtgttgatacatttgacgcttcaaaagaaaaacaaggtgtgtatgttaatttaaatcccggtagctggagttatgttggtgatattcaagaacgaaacttctttgtaaaaaacattaacagcaaaactcaagatgtacatcaatattttgatttaccggaaaaaaccactgtggatagtggaaatgggcaagttaatgccccattgaatattgctgatgttgaatatacttcggggcaagtctatattggtcaaggaacacaaatcgaaaatcttatcggctcaaatcataatgatacattgattggtaatgcggcagataataacatcttcggcggagccggaaatgataagttagaaggcggtgccggtcatgattatcttaatggtggtcttggtgaagatacgatgataggtggtttaggaaacgatatctatcttgttgataatacaaaagacattatcgttgaagctaaaaatgaaggcatagatacggtttacagcaccgttgattaccatttgtcagaaaatgtagaaaatctagtcttaattgggaatactgcaaaagcagcccacggtaatgagttagataatatcttaacggcgaataatatcggtaatacattaaatggaggagctggtaatgaccgtcttattggaggactaggtgcagacattttcatagggggagaagggacggatcattttgtgtttaacaccacccttaatggtaatgtggatatcatcaaggacttcagcacagaagacaaaattgaattatccaaaaccatatttctcgccttaaacgatgaagaaagtcttaaacgtcatattaaatatgataataccaatgggcaattaagttatgatgctgaaggcaatggtgatcttattcattttgccacgttagaaaatcatctctcaacattggataataataatttaattattgtttaaggtgaatatagaagaaacctttatttggtctcttctggcatagtagacaaaatggccactaaaaaatggcttaaagccttatattacgggctttaagccacttttttgaattatgaacccaaaaaatgtcatttttgccacagtagcgacattcgcaaacatggtataagaaataatattcaacgctatgaatgtaatgcttgtaataaaacatttacccttaaaaagaaattaaatccaccactatcacgtgatttaaatattattgcggataccaccttctttggtcgtgaatttggtattttactcctgatggattcgctttctaaaaaagtggtttaccatcgtgtcatcaaaacggaaaaagatgtttattacagaatagcatttaattcacttcgtatgaaaggctataacattcaatcaattacctgcgacggcagacggggtatattgaaagatttattggatacaccgacgcaaatgtgccattttcatatggtagctattgtgatgagagcattacgaaaaaagcatcaatctatagctggaaaagaattaaaaacaatagcattaacgcttaaacagagttctaaaaaaggcgtctatttacgattacatcattggtatttaaaacataaagcgtttttagaagaacggtcagaaaccgaatgaaaagggctattatccttataaacatcggaatgtaagaagtgcttatcatagttttaaacgttatatggattatctatttacctatgaaaagcatggcgatttaaatatcgaaaaaacgacaaatagacttgaaaacttatttgggcaactaaaggaaaattatcgcatcatacaggattaatgaaaagacataagattatgtttataaaggattttttaaataaaaagagttgctaagaataattaaaaatattcattagcagagcctctctcacaattcccactttccaattggggttagccaattttgcttcaacagcagctctcggcggtgcattaccttcggcaacccattcgtcccaagctcggttcatttcatcaaattcaatcatattgcttacaaaaacttgagccatcaaaattcgacttttatttgtgcctgcttgggctaaccatttatcaatttcggctaacacttgctttgtttgaccgtacatatcttgcgaatcatcttcagggacttgtcctgcaagataggctacaccgttataaattgccatttcagataggcgtttaccgacttgaaatcgttggatcattgttcctcctaatgaaagcggtgagtagatagcaaatttttgctattctctcactgcttgaaaatgaattactcgactttgacaatccagccttcaggtgcctctacatcgccaaattgaattctggttaattcagcgtataaacgtttagtgatagggccaacttctgtttcagaatagaatacgtggaagttatccccattttgaataccaccgataggggtaattacggctgcggtaccacaagcaccagcctctgcaaactgatctagttgatcgatataaacatcgccttcaatcgtttccatacctaaacgctctttagcgagatgaagtaacgagtattttgtgatacttggtaaaatagacgatgaagcaggggtaataaatttattatcttttgtaataccaaagaaatttgccgcaccgacttcttcaattttagtatgtgtttttggatcaaggtaaattgcatctgcgaatttacgctcaacggctaattcgtgaggcaacaggcttgctgcatagtttccgcccacttttacgccgccggtaccgtttggtgcagcacggtcataatcagacacaaggaaattcgctggagctaagccacctttgaagtaagcaccaacaggcacacaaaagacagagaaaatatattccggtgcagcacgaatgccaatattttcacccacaccaatcacaaatggacgtaagtaaagcgttgctcctgttccataaggtgctaaccattcttggtttgctttgacaacctctttacaagaacggataaacatttccactggcacctgtggcattaaaaggcgatcacaagtagtttgcatacgtttggcgttttgatctggacggaaaagattaatcgaaccgtctttgcaacgataggctttcaagccctcaaaacattgctgaccatagtgcaatgcagtagaaccttcgtgaatatgtaaagtgctgtcggtagttaattccccctcattccatttgccctctttccaatgtgcaataaaacgataatctgttttgatataagaaaatccgaggtttgcccagtcaatatttttagtcattgttgtgtcctttatttttttatatgagatatgagaaatttacaacgtttctacagaaaaatgaatgttttcaatgaaaaaaataagattttttatcgaaagtgcagggcaaccgcatatgttgtccatttttcaacctacacgccgagcaatagctcatctcgaaattcatctgaccaaccggcagcggtcaatttccctttcatactctgctttttcgggtgtaatcgtgccaagttcaacgctaatcgacgcaagattgccagattttccgcaccccattcatcggtcacagcacattcgtcttctttatagaccacatctagcacccaatgggctttgttttccacttcccaatgccctcgcacgcacttcgccaacatttgaatatcagcatccaaactacggatataaaaaactttttcttgcgattctttgccattatctgaccgcttgcgacacacctccaacaccgattttatccccttccattcctccgctttgctcagccaatcactcactttcagcttacggtagtaacgctcatcaattcgacgacgttccgcatttacctcctcaaaagtctcaagcatttcggggcaatctcggctgattttgtgaaaatacgcctccacttccgactgaaattgacggtaatttttcttcaacggcatcacataatctcctttcttttcgatgattttctccgcaattttcttctgtgtattcatcgcatccaccgttataacggcattttttaagcaaaaactgtcgataatttccatcaccgcctgctgctcattttgcttacccgaggattttttctgcgacaaaatcaaaccacgagactggctccacaccgtcacactgtgcaaagcactttgggtttccggattgaaactatgacgaagtgtcttgccatcaatcgcaatcacttcacgtccttgttgtgtgcgtatctcattgataaaattaagaaaaacctcattaaacgcttgtggctcaatgcgttttattacacgagcgatagtatcatcgacaggaatgccacactcaaaaggacgatattttcgcaaccaatccaaatgtaattcgccaaaaagtttgatttcagtccagctgtttgcccccgaaatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctgatgaagtgagtaactcttgctcaagccgagttgcataacgagcaaaattctgtgactgaaaatagcgattggcaatcgacgacttaaattgtggtgtttttgcatatttcgtattaaatatggattctgctacagcactcaacgtagagcttttatctcttgcataagaaaatagctcacgtagcccctgttgttcttggctgataacttcatccacttttaacagaagagtatctccctgctcacttaagctataatagtgggtcaaccaaggagaaagatccccttttactgacaattcacgaaaaccatttttatttaatactgagcgaatatttgatttttgtttcacgccatcagaaacctttttacaatttttcaaatcgtaaacatattccattgtatcataacgaccatctgcataatctacggtcgcataggcatctcctttactattgatatagacatttgtacctttgtaatgatgttgtaaatctatttgacattgataagcgtgaactgctggcaaagcaagtaaagtaactagtcccaatgaccatttcttcaatttttgcattttttactcctaaaaaagccgctcacataaaacgatatgtagcggcgataagattagaatttcataccaagtgcgagaccaaacaatttttctctgttcgtttgaacttccgttgcactttgttgatactcagatttaaaagtgccgtaagtgaaacgagcaaaaggaataagaggtaaattatccccattttgtgagcctatccattgatattcagcataaacaccctgacctggcttatatttcaacttgtttttaaaatcagttccttgtttatgtttttcagaaaattgtgactttgccacaaaatcttggtacactccagctgcaattgcagaagatgccccagggaaacggaaaacaagtccatcatagatactacctgaatttaaaccactataggatttttgttttaccgtgcccgtttctgaatttttagatttgctatcatgaggaaatacatatagagtccgtacacctagctctacatcagcccaatcacgaattggattaaataaagtgtaaactcctgactctccagaaaaaccgctcatatttggataattatcaacagaaacgctcttgtaataaccaccacctgctgaaaaaccaaaacgaaaatgccctaaacccgatgttgcctgatccaaatccttattcaaatcaacactagtttctgttgtcgtttttcctgtaagaacctcttgttctaataatgtttcattattttctgcggcaaaagccattgttggaaaaacaaatagtaaacctaacggtaagagtgaaaatcttttcatattaactcccagattgatattagagttttaggggatgccagataatcgtgccacattccccttaactcatagtcttgaaataagttgagattttaagctggtgttataaaacactatctgcataaaattttaagcagaagaatgtgcctttatggcaacataaaggcacaagaatgatatcattcttgcgaaaatagaaatttggacataagggaatgacaaatataggctaaaatatctaaagcttatttaagctttaaattactttaaaagcaaaaatataaaaaacaaaaaaccgcaggctatctctaacctgcggtttcttctctttaataaaaccccgacgatgctctactctcacatggggaatccccacactaccatcgacgttacagcttttcacttctgagttcggtatggaatcaggtgggacaactgcactattgtcgtcgggaaaatcttttgatgattctctctatcttcttttttctgttctttaagggcaaatataatttgcccctacactattcttattcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtctccaacaacccttacacacttattgtgtgggagaactcatcttaaggcgagtttcgtgcttagatgctttcagcacttatctcttccgcatttagctacccagcagtgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttactctttgggaggagaccgccccagtcaaactacccaccagacactgtccgagaccgcgtttcgcaatcttcgttagaacatcaaacgttaaagggtggtatttcaaggacgcctccacaatcactggcgtgactgcttcttaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgattacaccatcaattaaccttccagcaccgggcaggcatcacaccctatacgtccactttcgtgtttgcagagtgctgtgtttttaataaacagttgcagccagctggtatcttcgactggttcagccttcggaggtatactcctacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttccggcgaacgagtttttcactcgttttatcgttacttatgtcagcattcgcacttgtgatacgtccagcaaacctctcgattcaccttcatccgcttacacaacgctcccctacccaacagacgtatcactaataatcctctcttcgattactttccgactcaacgttcgggttgcttgaccaacatctctttccgtttcacttcattcgatgttgttaatcgtaaggcgtattagtgatacgcctgatgccgcagcttcggtgctatattttagccccgttacatcttccgcgcaggccgactcgactagtgagctattacgctttctttaaatgatggctgcttctaagccaacatcctagctgtctaagccttcccacttcgtttcccacttaatatagactttgggaccttagctggcggtctgggttgtttccctctccacgatggacgttagcacccaccgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactatccgcccagttaagactcggtttcccttcggctcccttattcagttaacctcgctacaaaatataagtcgctgacccattatacaaaaggtacgcagtcaccccaaagggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagcttagtaccacaacaaaaacttcgaatacggggctatcaccctgtgtcgcttggcttcccagccaattcttctgtctttgctgttatcactcactggctctttcgctttcgctcgccgctacttacaaaatctcggttgatttcttttcctcggggtacttagatgtttcagttctcccggtttgcctttcattactatggattcataatgaaatgatggattcttcatccatcgggtttccccattcggatatcttggattaaacgcttcttatcaactcatccaagcttttcgcagattagcacgtccttcttcgcctctgattgcctaggcatccaccgtgtacgcttagtcacttaactatacaacctcaaacatttttatctaaaaaaaaacatttaagactgatattaactactaaacacttaaccgcttttgttcagttaagattttcttactactcagactttcttgtttcagggcaaatatgatttgcccctacagaaaatctctcagttttcagcttgtttccaattttttaaagaacaatcgataatcacctttcggctaatcatcatatttaaataaacaactcactgttcgcttaaatatgatgattggtggagataagcgggatcgaaccgctgacctcctgcgtgcaaggcaggcgctctcccagctgagctatatccccaatgtcatcacatcgctttcttcgtttcactcactattcagtatcgatttctcttcaccgtttagagtggtgggtctgagtggacttgaaccaccgacctcacccttatcaggggtgcgctctaaccacctgagctacagacccaaaaggatgtcttcgttctctttcttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcaccctctgtatgcaccattgtagcacgtgtgtagccctactcgtaagggccatgatgacttgacgtcatccccaccttcctccagtttatcactggcagtctcctttgagttcccgaccgaatcgctggcaacaaaggataagggttgcgctcgttgcgggacttaacccaacatttcacaacacgagctgacgacagccatgcagcacctgtctctaagttcccgaaggcataaactcatctctgagttcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagcaacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtagtgctctattaaaacaccacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaactggccttgcggtcccagtctttcatctcccgatactacgcggtattagctacagtttcccgtagttatccccctccataagccagattcccaagcattactcacccgtccgccactcgtcagcaaagaagcaagcttcttcctgctaccgttcgacttgcatgtgttaagcctgccgccagcgttcaatctgagccatgatcaaactcttcaatttaaaaagtttaatcgctcaatatgtactgactataaaaaatcacgactgaatttattcaatcattatgaatttcaagttaagcacctatcaagacttcaaaattaaaaaaatatttttaaacaaagtcaatcaacaagtgcccacacagattgtctgataaattgttaaagagcaaaaaagaacgacgcactgtcaaatttaactactcacaacagcgcgtcgttgtgtggtgcgaattatagagaaatcctaaaccaacgcaagtactttttgcaaaaaatttgaaaaaaatgatcgcttgtttaaaataagctcataatgtttatttaaaaaacagaggttgtttatattttcatagacatatttacaaaatatcatacaaatatgctattagataacaaaaaggattagacccactcaaatagatctaatccttatggtatcaatttcatatcaccaattcacaggtaacttacttgtacaacttaaatatttagaaacgataggacagattggttccaatagcatttccctttaattttgtaccatttcgtttcaaattattttttgagtattctaaacctacttcaatatcattagagattgcatattttacaccaatcgcatatccaatccctttgaaactaccaaaatccgatattttattaatactataatgtaatttaacgtatggtaatatatctggtaggagacggtatccttgagcatatccaatactatattgggatttttgtttgatatcatgaaaaatattgctacttcctaattttgctttaccatcaattattccaattaaattcctaccataatctattgcatagtctaaagtaaagtttatgcctattgcctgcttaccttgcaaatcaccatttttatattttgtagttgtaacatccataccaattcccccacctgtaaaagtttcacctacaggcgcagctaaagcagaacttgataacaaagctactacgataaatcttttcatcataaatctcctattaagttagcgtagaaaatattattttattctaatgagatagatatatatcaaaccgatgttttttagtttccttacaaaaatcaggtttcttatttgctaaaaataatgcgtagttaggtctttttacaaccactctctttctagcaagttgctgagcagggaaaagtaaatcatctgaatctaaatcacagccaaccaattgttgaaatagttgcatctccttttttactaatgcacttttagtcttagacggatacataggatcaagataaacaacatccaccgagtcaagatctggatttaaaccagtaatagaactatgaggaagtaataccattctttctctcataaaatgaccaatttctaaatctttataagctctttgtaaaccatcttccaataatgcgccaacaattggattacgttcaataagtttcacatagcaccctattgatgccaaaacaaaagcatcttgccctaaacctgctgtcgcatcaataattgtaggagtatacgaacctttaacaccaacagctttcacaatagcctcattacgaccaccgccaaactttcgacgatacgacatttttccatcaacaaaatttacagctacagcacctaatttaggctgattaagtttccttaattcaaggcgttcattagtctgtactaatgctaaattagagctaggattatgcttcaatttccatttttcacaaatatcataaaagcgctcagtaaaatcactttcattaattaattgaatattcatatcatgaggtttaaatacaacataggaacaattctttgttcccatgttataaaattactttttaacacgagtgtgtaaccccttcttctctaaattacgataaatcaaccactgctgtgcaatcgtaattaagttagaggttaaccagtaaagtactaagcctgatgggaaccataggaaaaacacagtaaacatcacaggcataaagttcatcactttttgctgtacgggatcagcaattggagtcggcgacattttttgtaacaagtacattgacccccccattaatagagggaaaatgtagtatggatcttgtgccgataaatcttgaatccaaccaaagaatggcgcgtggcgtaattccaccgcttccataaatgtccagtataatgcgatgaaaattggcatttgaagaagaattggtaagcaacctcccattgggtttactttttcttctttgtaaagtttcatcatttcttggctcatacgctgacggtcatcaccgaaacgttcacgcatctcttgaatgcgaggttgtaacatacgcattttcgccattgaggtatattgagcttttgttaatgggtatagaatggttttcaccacaatggttacaccgataatcgctaagccccagttagatacaatactttgaatgaatgttaataaccagaataatggttttgcaatgaaccacgcccagccataatcaacggttaagtcaaagttatttgccacttgtgccattgcagcttgatctttcggtccagtccataaatggcttataatagtcgcttcaccattaggggcaacttgtgttacagacccacggtaaccgatagtgcctacgccatttcctgtgcgagtataaagattattttccgcatcttgatttgggatccacgccgatacgaaataatgctgtaaaacagctgcccaacctgctttagtatctacagataggttagcttttgccatttcatcaaaactatattttttatagttcacttcagaagatgaataagcaccacctgtataggtcggcattgcaaaattgccagcactttcaactaaagtatgtttaagttgaccataaggctgaacttcaagggtttctgccgaaccatttttgatgtgataattcaccgctacattatagctaccacgttttaaggtaaatgttttggtataaactacaccatctttttcaaatgttaatggcacagcaatctcattttgtccttcagctaacgcaaatttctctgccgtagcttgatactgagcacgacctgctgtggtatcaatcccatttttaccgactaacccactttgtgccacatacagcactttgccgttatcttgtagcaattcaaatggtgtattagagtctaattctgcgttatattttaagagatcagaatcaaccacatcaccacctaaagtatctacggttaaacgtaatacgtccgtttcaatagtaatggtttttcctttagttgattgctcattgatagatgccgcattagatgaagcggggacatcacttgattgatttgcaacttgttgtgtttgagcttgagccatcgcttgtttttgtgcttggatctcaggattatagtcctgttgccactgcgtaaaaatcaagaacgaaacaagcaacaaacccataatcagtaaactacggtttgagttcattttaagttctctgtggttaaagtgaagtggaatagcccactatggaaaagtatacattttaatataggataacaaactatccaacgccttttgcaagatagcggttggatttttttagagatttactaaaaagtactgcttcttgcaaacaaatgctcacaaatcagacaaacttaggattttcttactaatattgaagcaaaataatgtgatgaacgccacattttgaagaattacttcttttttattcttacgaaatccgacaaaataagtgtcatctagcaagaaaactcgtataattacgatgtttttatttttttattcttacaagaggtacacacaatgggtggtattagcatttggaatctagttattatcgttttattagttgtcttattatttggcactaaaaaattacgcggattaggctcagacttaggcgaatctatcaaaggctttaaaaaagcgatgaatgatgacaaagctaaagacgctgaatttgagaaagtagaacaaaaagctacagaatctaccgaacaaaaagcaaaagaaaaagagcaggcataatccgtgtttgatataggtttttctgaattagttttggtgtttatcgttggcttagtggtactaggtccgaaacgcctgcctattgctattcgtacagtgatgggctgggttcgtactattcgaggattggcagctaacgttcaaaatgagctttctcaagagctaaaactgcaagagttgcaagagagcattaagaaagcagaagagttgaatttaagtaaattatcccccgaattaagcaagaccgtagaagaactcaaacaatcagcacagaaaatgcaagctaacttagactcagcaagagggcaaattgaaagcctgacgcaagagcaagttaatgaaattcaaaataaaattgagcaagagagccagcaactttctcaacaagctgaacagcagaaagaaaccgaaaacccaccgcttgaaaccgaaacgctttcagcggatcgcattgcagaacttgctgaagcagacgaggataaattgacggcgtattatcccccagatgacgatcttgcaagtgttgagcctaaaacgaaacaggataaataatgtcagtcgaagaatctcaaccccttattagccatttaattgagcttcgtaaccgcttgttaagagcggttatttgtattttagttgttttttgtatccttgtttattgggcaaatgacatctatacattactttctagcccacttactgaacgtttacccgaaggggcaacgatgattgccacgaatgtggttacaccgtttttcaccccgataaaattaacggcgattgttgcagtatttatttccgtgccttatattttgtatcaagtctgggcatttatcgcacctgcattatataaacacgaaaaaaagctagtttatccactgttaatatcaagctctctgcttttctatattggtgtggcatttgcgtattatgtagtctttccgctcatttttggcttcctgacccaaacagcccctgaaggtgttgtaatggcaacagatattaatagctatcttgatttcattttaactatctttttagcctttggtgtctgttttgaagtgccagttgcgatcattttactttgttggtctggcgtaaccacagcagaagatctcaaagagaagcgtccttacattattgtggcagctttcgtgatcggaatgttacttaccccaccagatatgttctctcaaacattactggctgtgccgatgtgtctgttatttgaactaggactactggttgctcgtttttatcagccgaaagatgatgaaacagagtcaacagcacaatctgaataaataactatagaggcacaaaatgtgtctctatgtattttagataatgtatattctgctcaatagccatctgctgtagtattcccacatagaatacctttaatcaccttttgagaaccaatacattccgaaaccgaatattgattcaaatattgatagaaatgttcaagggcgtgatctaagacagatttcaggtgacaatgcggttttaaaatacacgcaggagaattgcaatctatcaatctgggattgccttgcaaggttctaatcacttcgcccacagccatagagagaatgagagaggaaattctaataccgccaccttttccccttgcggtgattagccacccttgttttgccataaaatgcaccactttcaccaaatggttctgcgacacttgaagcgattctgctaactgcggaatggtgtgaagctcatcttgatgatgagcaagatacatcaatacacgaaaagcataatcagtaaatttacttaggtgcatagttccctccatacttgataaagttgggcattaatgcccaacttatctttcccattactcatgagaagagagtaataaattccccaaggttttcaccccaatccccgttgcacctgctgcccataaatcacttgcagttttgcggaaggttgcagaacagtcaatgtgtaaccaattttgctgataattttccacaaaataggataagaaggctgttgcggtacttgcgcctgcaccaacaggaacagaaccgatattggcaatatctgcaaaggaagatgaaatttgagcacggtggaactcttcaaacggtaaacgccagaaaggttcgttttcggctttggctgcctcaaataaacgggcaactaattgatcgtccattgatagcactgaatggtagtcattgcccaccgctactttagctgcacctgttaaggtcgcacaatcgacaataaactgcggtttctgtttgctggcctcaattaaaccgtcggctaacactaaacgcccttctgcatcggtatttaacacttctgcggttacgccattgcgataagtaatgatatcccctaatttgaatgctcggctactcaccatattttctgcacagcaaagatagagtttcacacgttgttttaagccacgtgcaatagcaaaacctaacgcccctgtgactaaagctgcaccgcccatatcagtacgcattgtagacatactgtcacttggttttaagctataaccgcccgtgtcaaaggtaatgcctttaccgaccaaacaggctaacactggtgcatctgggttgcccgttgggttatagtcaagttgtaacatcgcaggtaaatgagcagagcctttaccaaccgaccaaatgccgtgataaccacgttcatttaatgcttcacgagcaacgatgtcaaaagaaaccttacctttgccgacatatttatcggcttggtgtaaaataaattcagctgctttgtgagccaacacttcgggggttaagcggtcagatggttcgttaataatgtcacgagtaaagctgctacacgcaaggcgagcatcaaattcggtttgttgttcatttaacgcaggataggtgactgagcctgcatttttcacgctaacaaatccttgatggaacgcccaacactgctctaatccccagccttcgcctgttaaggcaacatttaaaatgttctgatttttgattttgcgagctgcttgttgaatggtggttaattcatcttttaccagatgaattgtcataccttgatcgtttgccgataaaattgcattttttccccaaacttcaggggcggcagttaatgataatgtgatttgcattgaactcataaagactccttgatatatagctatataaatacttttacacttcatccaatataactttgaatattgtcaataaagtattattgccaatcctactaaaccccctactaaaagtctatcgttcagttcactctaagatacattgtgaaaaaataaacacatatcacagatattattcatttttttaacatgatgtaataatcaaaaattgggaatgtatcttcaaagctaataacaagtaatgaatcaattaattttggtgatctcttaagcgatcaccaagagctaaggatgaaaacgaaagtaaagaagagcagctcttaagccttgattataagagtttaatctatcttttacctctcaatccgcccaaacttcccactttgtacatcacgcatagcttgaataatttcttctcggctattcatcacaaaaggaccataacctacaacaggttcatttaatggctctcccgtaagaactaacagtttagcatcgttattcgcctcgatcagaacatcagcaccgccacgttcaaaggtcactaattcaccacgacgagcaatgtcctcgccattaatttgtactgtgccatctaacaccaaaataatcagattatggctttctggtacagcaaaagtatgaactttacctgcatttagtaccacatcccacatattaatcggactaaaagtactagcaactcccgaagtacttgatagctctcccgcaataatacgagccattccagcattatcaccaagttgcacgacaggaatatctgccgatttaatcgcctgatattttggtgttgtcattttgtgagctttaggcaaattcacccaaagttgtaccatctcaaacattccaccttctcttgagaaacgttctgagtgaaactcttcgtgcattacacctgaacctgccgtcatccattgcacatcacctgtcccaatagtaccgccaccaccataagaatccgcgtgagcaacttcgccttgatacgcaattgtaacggtttcaaaaccacgatgcggatgctcgccaacaccacgaaaatccgatttgcgtccaccatcaaaatggcgaggtgggttgtaatccatcaataagaacggatctaaatttttatcggtatcgttatagctaaacattgattgaacgtggaacccattgcctacccagtgttttgcaggtgcagtatgaacatttgcaacttttttcattttgttatcctttgtttatagttaaatgttgcgagtgatttatcacatcgctcttgatggggcacattataatctcatctaaaatttgataaatataggttttattgactaactatttaatataagtaaataataaaaagaaaaatcgcaaaaaaagataaaatcattataatgtcgcctttcacagcggtgcgataatgcaaaaatattgcaacatcgtaccgcttatttattcaatcgtggttcgcaaacctcccacgcaaaaaaactaaggaacacaatgaaacctacacctaaagctgccgtgattttttcaggcggacaagattctacaacttgtttattccttgctatcaaagaatttggcaaagaaaatgtcgaagccgtcacctttcaatatggacaacgccacgccatcgaattagataaagcccgttggattgctcaagatcttggcgttaaacagaccttaattgatacatctgtgataaaagccattacggctaatgccttaatggacgatcaagctgaaattaagcagacaggcaacacccctaacacctttgtagatgggcgtaatgctctttttctactttacacagccatttatgcaaaaagtcaggggatccagactatttatactggtgtatgtgaaacagattttagtagttatcctgattgtcgagatgtattcattaaatcaatgaacgtaacgcttaatttagcgatggattacaacttcaatatccgtacaccgttgatgtatctcacgaaaaaagaaacttgggcgttagctgatcaacttggggcatttgactatatccgaacccatactcacacttgttatcttggcgtagaaggcggttgccatacttgcccaagctgtttgttgagagaaaaagggttaaacaaatatttagaggaaaaaagcaatgtttaaaatcgccaaagaatttagttttgatatggctcatatgttggacggtcacgatggcaaatgtaaaaatctgcacgggcacacctataccttacaagtagagattgctggcgaattacatacggacggtgctaaatcgggtatggtgatggattacagtgatctcaaagcggtcgtaaaacagcatattctcgacaaaatggatcacgcctttatctacgattctacgagtgaaaaagagtgcaaagttgccacattacttcaatctctcgattccaaaacctttggcattcctgctcgtaccacagcggaacagatggcgaaatacatttttgacacactcacaacggaaggactacctgttagtcttattcgtctatgggaaaccccaacgtcttattgtgagtactgccgataatgaaaaatccagaataccgaattgtcgaaatctttgaaacccttcaaggcgaagggttcaacacgggtatgccgagtatttttatccgctttggtaaatgcaatctcgcttgtccttggtgcgataccaattacaaccagtatgaaaccaaaacccttgcagatattatgcaagtggtcaaaggtttttccgcaaagaacatcattattacagggggcgaaccgacaattcagcccgatttagcgtatctgctcgataccttgaaagcagcaggttattttattgcgatagaaactaatggcttaaaacctgttccgccacaaattgactatatcgccactagccccaagcggttatatcagaagaattatttgaaacatcacattccctttgctaatgaagtgagaattgtggtagacggtgatgtactggcgttttgtgagcagatagaaagcaccatcaaagcagagcgttactacctttccccttgtgaagaaaatggggtgatgaatatgttagaaaccatcacccaactaggaaaacttaaccagcgtccgaacaaaccccgttggcagttaagtattcagacgcataagatggctgggattgagtaatactgaaaacgcttaattgttgcaattaaactattctgctacttttacttcttttgtcccacaaccaaaattaataatctcttgctcagacataagaggataacggcattgcatttttagatagagaattccctcatctgatagagtgtcttgataacctactctagcctcttctggggatagccccgaagattcttgatgtctatttatactatattgtaacgatttaggtttactagatttctgagattctggctcattgatatcttgcgccaataatgaattttcattattgctatccacaacagaagcctgttcattttgaactgaaatagattgtctagcttcagccttttcatctgatgaggaggtctctgttatatccttcttagaatcaggaatttttacttgggaagctcccgcttctgagacctcagattttagagattcaacttttgatgcttcaacttttggcgactcaacttttgaatcttccgcttttagtccttctacatcagctttatcttctcccttttcttgaataatatccttcttaggttgttcaaagcaggcagttacagaaaatatagcaataaaaattaataatagtttattcataaaaaatatccttaaataaaaatcaacgcattgtcacaaactcttccgagcctgttgggtgaatggagactgtgttatcaaaatcagctttggttgcccccattttgattgcaacggcaaaaccttgcatcatttcatcaacaccaaagccaatgccgtgtaagccaacaattttttcttccttgccgacacaaactaatttcattcggcaaggttggcggtgttgtgttacggcactgtacattggggtgaatgaagatttataaactttcacattttccgcaccgtattgctcaaccgcttttggctctgttaaaccaatagtaccaatcggcggatggctgaaaactaccgtgggaacaaggttgtaatccaaatgttcatttggcctattgttgaataaacgctctgataaacggcgacctgcggcaacggcaacaggggttaattcaattccgccttcaataatatcgcctacggcatagatgccttcgacgttggtattctggaatttatccaccttcacaaagccacgttcatttgttgctacacctgcagcgtcaaggttaatcacgtctgttgctggttcacggccaatcgcccataccaagcaatctacgctttgttcttcagaattttccaattttaacgttaaagagccatcagcatttttaacgacttcttgtggaatagcatgagtatgaagttgaataccatcttggttcatcacttctaataaagtttccacaataagtggatcgaaagtacgcaaaggggcgtgttggcgaacgaataaatgggtttctgcccctaagctgtttaatactcctgcaagttccaccgcaatgtaaccagcccccacaaccgccacacgttttggtacatcatctaaggcaaaaacaccttcagaatcaatgccatattcagcccctttaatcgcagggcgacttggacgacctcccgttgcaattaaaatatgatctgccgtgattttctctacgccaccgtctgccaaggcaacttcaacggtattcttattcacgaattttgcaaacccacgaataacatcgacattgtttctagctaaaacgttattgtaagaggtatgaatacgtccgatataggcttgacggttttcgactaatttacggtaatcaaaacgattgatcgtcacatcaaagccgtaatctggtgcatagcaattgatcgcttcagcaatttgagcaccatagaacatcactttttttggcacacagcctacgtttacgcaagttccgcctaggtgttttgcttcgataatggcacattttttaccataacttgccgctcggttaatagaagcaatgccgccgctaccgccgccaatagcgatatagtcgtaatgtttggtcataaaaggctccttaaaattatctttatttcatatccataacacacattaaaaaaacatagccacatccagccataaaagatatggctgatttgactattacttcgcaatacgcttatatttcatacgatgtggctgtgtagcttctgcaccaaaggttttctttttccactcttcgtagtctgagaagttaccttcgtagaaagtgactttaccttcatcaccgtaatctaaaatgtgagttgcgatacggtctaagaaccaacggtcgtgcgagataaccattgcacagcctgggaattctaagatcgcattttctaacgcacgtaaggtttccacatcaaggtcgttggttggttcgtctaataataagacgtttccgcccgcttgtaacaatttcgcaaggtgtaaacgaccacgctcaccgcctgataattcgccgacacgtttttgttgatctacgcctttgaagttaaagcgaccaacataagcacgacttggaatttcaaagttgccgatggttaaaatatcttgtccgtttgagacttcttcccatacggtttttttgtcgtccattgcatcacggaactgttccacagaggcaagcaccaccgtttctcccatcacgattgaaccgctatctggctgttcttgacctgaaagcatacggaataaggttgatttacctgcaccgttcgccccgatgatccccacaatcgcccctttcggaatgctgaaagataaatcatcaattaaagtgcggtcgccgtaagatttggttagattgctcacttcaatcactttatcccctaaacgtggaccaggtggaataaagagttcgttggtttcgttacgtttttgatattcgcctgagttaagctcttcaaagcgtgccatacgcgccttgcttttcgcctgacgacctttcggattttgacgtacccattccaactctttagcaatggatttttgacgagcattttccgccgcttgttcttgctctaaacgtttctctttttgctctaaccaagatgagtagttaccttcccaaggaataccttcaccacggtcaagctctaagatccagcctgccacgttatctaagaagtaacggtcgtgggtaattgccaccacagtaccttcgtagtcgtgtaagaaacgttctaaccacgccaccgactccgcgtctaagtggttggtcggctcgtctaataacaacatatccggtttttcgagcaacaaacggcaaagtgccacacggcggcgttcgccccctgaaagatgttcgattttagcgtcccaatctggcaaacgtaacgcatctgctgcacgttctaactggttatctaaattatgaccatcgtgagcttgaataatcgcttctaattgtgcttgttcagccgccagtttatcgaaatccgtattctcatcagcataagccgcataaacttcatctaaacgagtgagtgcatttttcacttctgaaactgcttcttcaatggcttcacgcacggtttgctgtggctctaatttcggctcttgcggaagataaccgattttgatccctggttgtggacgagcttcaccttcgatctctttatcgatcccagccataatgcgtaacagggtggatttacctgcaccatttaaacctaacaccccgattttagcccctggaaagaagctcaatgagatgtctttcaaaatatgacgcttcggcggaacgacttttccgacacggtgcatagtgtaaacaaattgcgtggacatatacattccttttctgacaaaaattagggggtattctacttgaaatcaggggcaaaatatagctttgcctttacattcattagaaatctgattaaaccaaaactctgcctgtgataaaataaaagatcaaacccaagctaacatatgccaattacttgggacatagttagttaagtttgatcttcttaaattaccctatattgatgttagaacgagtatcttacattggaattaacagataaatccgtattatattttccaaatgcagagccttctaaactcaagcctatacttaacttatcattagctctgatattaagccccaagtccatcaacattctggcatcttttttgctattgctagcacttataccatctaccaaaatttcattgcgttttgcaatatcccattgatagccaatgccagcccaagcggtcgctttgctctgtccaatttcaaaagttttacctgcattcacacccaaacgaccaaccagtccatttgagacttttatggttaatttatgtccgttatcagctaaattagcttggctatttttgacataaatcacttccgcttgtggttcaacataacctgaacctaagttaaatctatagccaacttcaccacccaaatagaatgaatgggtgttatatcgttgagatttaaaatctaacttcatttctttaaatgcgtagtcaaatttatggttatttttgacatatttagcgatggtatcaagataaaagccgttatcaaataacgctgtcgcataaacgcctgcaccgatagattttacatcgccgttcgttgagccgatttttccttcaatgtctgttgaagtatgcgtcaccgttaccccagtaaataactctgcatttgaaaggtggctttgtttatcaaaacctgtctgaatatgggtaaatttatgcttatagctatcgctactacctttacctcctaatactctagcccatacgccagcattggcgtcaataccacgtaactctcccattctcttattgagattgttcatttcaacgtggttaagatcagtatgcaatgaagtaagttcattagcttctttgatcgcagcttgatttggtgatttcgtgatatggatatttccattttggtcttgagctaaatcatagttcaccaagcccgtattgttcaccaaaatctgcttgctatttggatcaattaaagcaatatcaataccttctctttgaattaggtaacgagttacatcaccgacacgagtggttacaaaacttagctcttgataattagcaatagcttcttttaatgatttcaccgctagacgttctgcggtttctggttctgttggtttaacctcgcttacagtcgctgtttcagttgaagctaggcttggagcaggctcaggtgctggctctgcaacttcaggagttggcacagcggtcggttgctcgcttgtttctgcaactgcttctgctgttggcttagcatcttcagtagcaacaactggcgtttctactgctggctgagcagtattatctacacttggctcatcgctattttcattagctggagtgcttggtgtattttccgtttctagcactacggtttctgcatttgacgcagagctgtctgttgaagtgatttcactgctattttcttctgacactgtggtttcagtgtttgatgtagcgatttgctcgttattttctgcaacagcttcttctgttggagggacttcacttacagtctctgtttccgatgtctctgtatttgatgattgagcatctacatctgtttcttctggagctggttctgtcgtgactgtactcgcttcgttagtattctcagctactgtctctgtattggttgaactattattttcagttgcagtagtcgttgttgtactgttactaataccacaataactagcatcagctcccggagctaaacttaatttacaatcctctcggttagtggtgtctttataagtaccattatttcgcgtttcatcaatactcacataagtaatgctgtaaatatcgtacacatcggtgacatatttatttccatttggaacatagtaactataaagaaaacgaaaaatttcattacctttattatcaagtacataatcccctgtcacctcaaccattttaaggtttcctgcctgatctgctacagagtcactgatataaccttttttaattttgccagttttttcatctacctcaatgccccataaagtcacagtatgtgtccatgatgttagcgcggcaacaacgtttccagttttgaagttttcaaccaatgattttgtaactaaagctgcattagagtcgtaacgctcagtccaaaatggaccaccactgatttttgttggcccacgctgtgcctcataagaagttttcgtattatgagtttcatataacttaacagtgggagcaaaatcctcaaagaaatattccattccacgaaatgggtataatcctccctgtatgtttggatatttcttatttaaccattttgaaatctccttattatcgtttggtgtattgggattaaataaaacaggggtttttaattctcttttccaccaaccaagcatatttcctgcaacagctccccagcattggttaggatattgaaaatcagcagtccaacctttttgcttatcaactccacttgcccagtagacatcgtctgccaaaacattaacagaggatgaaagtagagcagttatcaaggccttcgaaaaataaggcttcattatgatctcctttaaatttatggaaagaatactgaaattatactggtaggaaaaatctgaatacttttataatagctcattgattaacgatgagaaacacaaaaacccatcagttaaatttcaccgatgggtgattgtaaactttttaatcagataaaactttgagtaagctcaatatatggttatgaaaatgtcgatattacctaccgcctatttcatcacgctactttacattgctctctctgtatcgcacgatacccaatatctcggcggtaaaaacgcccttgccactggatctgttcggcaagttttaaggctttttgctgtgcgtcagataccgtagaacctaatgcggtggcacacagtacacgtcccccttttgtgactaatttcccattctgttggtcaacacctgcaagaaagacctttttatcggcacagcaatctgtcggaattcccgtgatttcatcattttgacgataatctgcaggataaccttcggcagccagcacaatccctaacgctgcttgttcacaccattttgattgtatctcgtttagcttgccgtcacaggcttttagacagagttcaacaagatccgactccaatcgcatcataattggttgtgtttcaggatcaccaaaacggcagttaaattcaatcactttaggttgtccatttggcataatcatcaagcctgcatagagaaaacctgtatattcattattttcactcgccataccacgcactgtcggataaataatttcttgcatcacacgttgatgaacatctggagtgacgacaggggcaggggaataagcgcccattccacctgtatttaagcctgtatcgccttcacccactcgtttatgatcttgactggttgccattggctcgacgtttttaccatcgaccatcacgataaaactggcttcttcgccagctaaaaattcttcgataacaacacggctaccagcatcgccaaacgcatttcctgaaagcatatctttcactgcttcttcagcttccgccaatgtcattgcaacaatcactcctttaccagccgccaaaccatcggctttaatcacaatcggggcatttttttggtgtaaataggctaaggcaggttcaatttcggtaaaggtttgatattctgctgttggaatgttgtggcgagctaaaaagtctttggcaaaggcttttgacccttctaattgagctgcagcttgagttggaccaaaaatttttaatccagcggcacggaatgcatcaacaacgccgataactaaaggtgcttcaggtccgacaatggttagccccacctcattttctttggcaaaattgactaaagcggtcagatccgttgcagaaattgccacattttcaatccctgcttcaagcgctgttcctgcatttccaggcgctacaaaaaccttttccgctaaaggtgattgacgaaatttccacgccaatgcgtgttcacgaccaccgttgccaataatcaaaatattcattgaaattcccctgtaaaaaatcgctaaagatctgaccgcttgcaaaaaagcaaacgtttgcgtagtgtataggatttagtgatgaacaggaagcattatttattgagaattagcattaatatctatctataatcatatatccaacattctatgctaaaatctcccctattattttttacagagaatcaactatgacaatgattaaaattgcacaacaagccaaacaagcgagctttgagttagctcagtttggcaatgttcaaaagaaccaagccctgttcgcaattgccgatgcgttggaacagcgtaccgatgagattttagcggtcaatgcgaaggatattgattatgccaagtcgcaagggatttcagaggcgataatcgaccgcttgttgctaacacctgagcgtattcgtgggattgcaaatgatgtgcgaaacgtcgcaagccttgccaatcctgtcgggcaggtgattgacggcggtgtgttggatagtgggttgaaaatcgaacgccaacgagtgccgttaggggtaattttgactatttacgaagctcgtccaaatgtaaccattgatgttgcttcgctctgtttgaaaacagccaatgcggtgattttaagaggaggaaaagaaacgaaatttaccaatgcgattttggttgaagtcgtacaatctgccctagagcaagctggcttaccgaaattagccgtgcaagccgtcactgatcctgatcgtgctttattgctcgaattgctcaagttggatcagtacattgatatggttattccgcgtggtggggctggtttacatcagttctgcaaagaaaactcgactatccctgtgattgtcggcggtatcggagtgtgtcacctgtatgtggaagctagtgcggatttagagcgttcgctgaatgtgattgccaatgcgaaaacccaacgtccaagtacttgtaacaccctagaaaccctgttggtcgataaggcgattgcagatcagtttttaccgaaacttgcggaacatctttgccaattgaaagtgacattgcatagcgatgatttttctgaagaactgcagaaaaatccgcaaatccaaccgcttgatcaagcaaaattacgtcaagagtggctgtcgttggatttgagcgtggtagttgtagatggtattcagcaagcgattgagcatattcgtacctatggcagccaacattccgaagggattttaaccagtaactatgctttggctcgccagttcgttcaacaagttgatgcggcagcggtatatattaatgccagcactcgttttaccgatggcacacaattcggtttaggggcagaagtggcggtaagtacacaaaaactgcacgcccgtggaccgatggggctagaaacactcacggcctataaatgggtgtgtgaaggggattatttgacgagaaaatagtgtctcaaagatataaaaaacatctatgaaatataaagagattcaatatttttaagctatactacataatatagggaatcttagatatatcttgcgctggtacaaagtgttaagcgctaaaaaaatttacaatgattcgtcaatacaatttaaaaacacatccaatgatttgaaggagaacataatgaaaccttatctttcgaagatcgtaatagcgacacttttttcttcatctgtacaggtagttgaagctcagacttattgggcaagtggagtcaatcaaaatagtggatggactgctgatttacaatatccaaatcagtgttggggcgctgttgcaggaaatactctcggatggtggaaaagtagagtaaaagcgcaagtagaatttaacgaggatactcctaaagatagcaaagccatttcaggatggatatataaaacttatccgcatatacagggtggattacaaccatatcgaggtatggagtattttttctctcgttttgcatcaggagtaaaattatacgaagaacataataaaaaaacgtattatgaaagtgagagaggtccaacaaaaattagtggtggtccattctggacggaacgttatgactcggatgccaaattagtcactaaatctttaattgataattttaagacaggaaacgttgttgcagcactcacttctcagcaccataccgtaaccttatggggaattgaagttgatggggatggtaagataaaaaaaggatggattagtgattctgttaaggataaagctggaaatcttaaaatggttgaggtggtaggaaattacgcaaaagacaataaaggaaatgatatattccgttttctttacagctatgccgttgacggtggtcgcatgtatgtaacggatctttatgatatttatagtattacctacctcagtatagatgaggcaagaaataatggtacttataaagatacatctaatcgtgaggattgtaggttaagtttggctcctggtgtgtcaggaagtttttgttcaattaatagtacagcaactaatactacaaaggtagagaatgtatctactactaacaataactcaacaaatcttccaacaaaagttgaaaatagtggctattcaaatcaagtcattaatgctgcatcggcatcagatgatactgtaagttcagcatccgaaaataatgattcggtaaatacaccggaaaatatcgaaaacagtaatggggtagatataggtaataattcgacagtatcttcggcaaatgttgaaaatagtagtaatgaggttagtgtaattaatacaccaaatacatcaagtctacctaacgatcaaggaactaaaaagattattgttgataattcagaaagcaacgcaaaagatcctatcataagcaaagcgacagaatctttaacaaaggaaattaattcgtacccagaactaagttttatcactaagaatatgggagatgtaacattttatattgtgcaaaaagatggtgttgacatagctttgattaatccaaaaactgaacagtcgttagttagtaataagggattagtaatctatgatttcaaacaagaccaaaatggaaatatccatatcacgaaatcaccaaatcaagctgcgatcaaagaagctaatgaacttacttcattgcatactgatcttaaccacgttgaaatgaacaatctcaataagagaatgggagagttacgtggtattgacgccaatgctggcgtatgggctagagtattaggaggtaaaggtagtagcgatagctataagcataaatttacccatattcagacaggttttgataaacaaagtcacctttcaaatgcagagttatttactggggtaacggtgacgcatacttcaacagacattgaaggaaaaatcggctcaacgaacggcgatgtaaaatctatcggtgcaggcgtttatgcgacagcgttatttgataacggcttttatcttgataccatcgctaaatatgtcaaaaataaccataaatttgactacgcatttaaagaaatgaagttagattttaaatctcaacgatataacacccattcattctatttgggtggtgaagttggctatagatttaacttaggttcaggttatgttgaaccacaagcggaagtgatttatgtcaaaaatagccaagctaatttagccgataacagacataaattaaccataaaagtctcaaatggactggttggtcgtttgggtgtgaatgcaggtaaaacttttgaaattggacagagcaaagcgaccgcttgggctggcattggctatcaatgggatattgcaaaacgcaatgaaattttggtagatggtataagtgctagcaatagcaaaaaagatgccagaatgttgatggacttggggcttaatatcagagctaatgataagttaagtataggcttgagtttagaaggctctgcatttggaaaatataatacggatttatctgttaattccaatgtaagatactcgttctaacatcaatatagggtaatttaagaagatcaaacttaactaactatgtcccaagtaattggcatatgttagcttgggtttgatcttttgtttttactaaagaggcatgtcgaattgaccacagattaagagagaacttaatacaagcaaacaaaaccccaacagaatatgccacaagccattaagctatgctaaacttccccatcttaaggggaaataatatgaaaaatcttatcttcttttttaaactctttatccaccgctttcaacaaaacaaaattgcggtctattcagggtatctgacttataccacgttgctttctctcgtaccgctgattatggtggtgttttcggtgtttacgctattaccgatttttgaacaagccaccgcacagttaaaagagctggtgtacgataactttgccccaagtgcagggaatatggttcagcaatatcttgagacgtttgtcgataactcaaagaaaatggggatcatcagtatcatcggtttagtcgtggtggcggtgatgttgatttcgagcattgataatgcccttaacgaaatttggcataatacgaaaaaacgttcagtggtactctctttcgttgtctatttagctgtgctgatttttgccccgatttttgctggagcgagcattgccatcagctcttatattttctcgttggaaatgtttagccaagacgggctgttttcttttagccaccacctgcttaaatttattccttttgtcttaacttggttgctgtttgccttggtttatcttattgtacctaacacccaagtgaagtttagacacgctgcggtgggggctttatttgctggagttttctttacgctgggtaaacaaattttcatctggtatatcaccactttcccatcatatcaggcaatttatggtgcgttagccacgattccgattatgattgtttggatccacctaagctggcgagtggtattattaggggggcagtttgcttctgtattaaaagatatggaaatgatcaaggctggcgaattagcaaatccattaacggaggacagagaatgatcggattaattcaacgagtaaaatgggcgaaagtggaagtagataaccaggctgtcggcgaaatttcaacgggactattagtattattaggtgttgagcaaggtgacgatcaggctaaggcagatcgcttactggaaaaagtcttgaactatcgtatctttgccaatgaacaaggcaaaatgaacctaaacgttcagcaagcagggggaagtttattagtcgtttcccaatttacccttgccgccgatacccaaaaaggtctacgccctagcttctctcgtggggcaaccccagtacttgctcaagcactttacgactattttcatcagcaagcggcactcaaaatccatacccaaacaggacggttcgccgccgatatgcaggtcagcttacagaacgatgggcctgtcaccttttggctacaagtataggcacggaaatgtaccaacagttccagcaacaacttgcaaagcattgccctaatcagaccgctttcttcatcggtttaagcggtggggtggattcggcagtcttactgcatctgttcgcacaggctcgacaagcccttaaccttaaactcagggcaattcatatccatcacggcttaagcccaaatgcagatagctgggcaacattctgtgaacagctttgtgaacagtgggcaatccctttgactgtctgcaaggttcaagtacaaggcaaacaagggctggaagccaatgctcgaacagcacgctatcaagtcattcaacagcatattcaacggaatgaaatgttggcaaccgcacatcatcttgacgatcaagttgaaacctttttccttgcattaaaaagaggaagcggtattcaaggactaggggcaatgcaagcggtcagttttttgcaaaatattgcgattttccgaccgcttctcagcttcaataaaaccgacattctcacttatgctgaacaacatcgactggaatggattgaagatgaaagcaacttcaacactgattttgaccgcaatttcctacgtcaaacggcattacctttgctcaatcaacgttggcaacagtttaatcaaatggtggcacgctcaagccagcattgtgccgagcaacaacaactgattgaagaattgctacaccccgaactggctagtcggctacaaaatggcggtttagacatcacaggctttgagcatttttctttgttaaagcaacaacagcttgtccgtttgtggttggcacaggctcaccttgcaatgccaagcgtggctcaactggaacagattatccaacatctcattttggcaagagccgataaaaatccgcaggtcaaacttgaacaacaccttattcgccgttaccaacagcagatcttcattacccctattcaagcagagacagatgattttgacttggaactgccaccacaaagtgaagaaattcaactgcccacctctattggcattgttcaacgcaacggcacagagattatttacaaaatatcaggcaaatctcaccgcttgttattgccagaagcgttacaacaaaccccacttcgcctgaccaaccgctctccaagcaaagtgcagtgttacggcaaaaaccatcgagaagagatgaaaaagatttggcaggaaaatcgtatccccgtgtggttacggggacgtgtgccaattatcttttataaacaagtattaatagcaattttaaaaatctagtcattcttcacaaaatagttacaaaaataggattacccgaagaatcatatccaacggccacaacaatccttgaatcttttcccagatcgacaaatacacaattttttcatagcaggcataggaactgttggatcaaaaaaataccaacgatcatctacatttacaaaaagagaacattcatgatgaatttgcacaccatcttctgtattaaagtaagccctaaattcaacaatactatgaattttagtcacattttcttggttagaaataatatcaagacctatccactgagtcttttggctccaatctcttattgcttttaggtcaagcaatgattgctgagcagggagtgtcgttctaactatatagtcaatattaactttggtgtaagcagaataacgagaacgcatcaattcttcggctgtaataggcagtttttgagcaaaatgaaatggtttacagcattcatcatatgctagttttgattggcaaggacaaacataaaacataacaaaatctttaaaaagctctctatctaacttaatatctttatttataggaaaacattatgagtaactgttattactaaaactcatacaccatattaatatacggaattcaataactaacaacggcacactcacccacaacggcaacgtttcaaacttccaaaacgtacccgcaatcgctatgcctaaaatcattaaacgggaaaagcccgtgttattacgttgtgctttcaggctttgattgatttcatttaaacgaaaattaatctgtttttgttgttgcaaggcttgaaacatcgcttcagggaactcggcaaaatgttccctaaattgcggagctcgctgttttagatctcgccacatagccttaaagcccacttgttcattcaaccaatcctgcaaaaacggcttagcggtttgccataaatctaactgcggataaacctgtctgcctaatccttcaatataaagcaatgttttttgcaataacaccaattgtggctgtacttccatattgaatttacgagcaacagtaaacaaattcaataaaacgtgtccaaacgaaatttccgaaaggggtttagcaaaaatcggctcacagacttctcgaaaggcttcctcaaaagcatcaatatcggtatccgacggtgtccaacctgactcaacgtgcatcaacgcaactcggcgataatcacgattgaaaaaagcaacaaaactttcggcaaggtagcgtttatcgttctgatttaaagtgccgacaataccgcaatcaatcccgatatattgtggattttcggggtgatttgggttcacaaaaatgttacctgggtgcatatcggcgtgaaaaaagctatcacggaaaacctgcgtaaaaaacacctgcacaccacgttctgcaagcagtttcatatctgtgccgttggctttgagttcatcaatatttgccacaggaataccataaatccgttccatcacaatcacatttttatggcaaaaatcttgatacatttcaggtacatagagcatttcactgttttcaaaattattacgcaagcggatagcattcgccatttctttgcgaagatcgagttcgtccaacaacgttttttcatactcacgcaccacttccacagggcgtaaacgtctgccttctttatttaaacgtggaatccaactcgccaagcggtacatcaaggctaaatcgtccttaatcacacaatcaatctctgggcgaaggacttttaataccacctctttacctgcaagcggttgtttttgattaaattttgccgtatgcacttgagcaatagacgcagaagccaaagcggtttcatcgaaatcatcaaaccacttttccaacttatcgcctagagcctcttcaattaaacgacgagccagttttccgtcaaaagcttcaacagaatcttgtagcaacgcaagctgatctgccaactcaggttcaaacagatctcgacgagtcgaaagcatctgccccagcttaatccatacaggcccaagctcttgcaaggcaaggcgtaaacgcacgccgaaaggctcattcggatattgattttttacccaaaataacgacttccgcccacaacggatcccccgtgttagcggaatatctggaataacctcatcaataccatagcgaagaaaggtatgaataatgtgataaagacgacgcaggtttttgatgttcattatattcccaattttacaaatttttgctctaaccgtaccgcttgctgttccaactcttttacctgatcgcaaaaatcaactacttgcaaacgatgaacaaacacagggcgttcgttcgtcaagttatcgacaaggtgctgactgtcttgcacaaactgatttttcaccttggtaaaaatacccttggcgaaatccgttgaagcctgagctggtacatcaccgataaaacgtgagagcaattccgcaggatctttttccaactcgtcaagtaactgtgaaaaatgctgtaatacttgaatatcacccgtcaaaatcagtgttttattattaatcaactcactcagtttacttttatccgccagttttggaagagctgtcgcatcaaggctcacggcacaatcaacttcaccctcataattcgccagccaatccgcacggttttcactgaaaattacaaaaagtataatattcggttgatttaactgaattttaagaattttccctgcaagtttgcgtaacatcgacgatgtttggggtgaacgttcaatcaaatgattaaacgccgtttccaatgcccctaacgcaaattgcggtaacatcaactgttgtaataacgttttcatttttaaaatttgtacccacgatgtaatgctacaatcccagcacttaaattgtaataaccgacattttcaaaccctgcattttccatcattccctttaactcgtcttgtttcgggtgcatacgaatagactcggcaaggtagcgataactgtcggcatcattgacaaccacttcgcccactttcggcaaaatattaaatgaatagaagttataaacttggctaatcggatcgataatcggcttagaaaattccaacaccagcaaacgtccgcccggtttcaacacacggaacatcgaacgtaacgccttatctttatcagtaacattacgcaaaccgaagctaatcacaatgcaatcaaaggtgttatccgcaaacggcaagcactctgcattcgcttgcacataattcacattgccgacaacgcccaaattccgcaatttctcacgccctacttccaacattgaactgttaatatcagcaaggacaacttcgcctgtttcgccaacaatacgagagaatttagcggtgaaatcccctgttccccctgctaaatccaacactttctgcccctttcgcacgccactgcaatcaatggtaaaacgcttccacacgcggtggataccaaaagagagcagatcattcattaaatcatatttgcctgcaacgctatggaacacattggcgactaactgctgtttttcttctttggcaacggttttaaatccaaaataggtggtttctgattgtggttgttgagattgttgagcgtcgttcattgtttcgttctcatgagaaaaaattaaggcgtaccatatcaaaaaagcggtgagatttccttaattttttgctaaaaaattacgaacttaccatttcgcagtatattaatgttaatccttttctgccttagtagtaataacattattctatatatttcactttattaatgaaatcaagcaaaaatagcgcaaagaaggatatcgacttaatctcacactctataaataaaaaatctgcactttattatgttagagactaaacctaacgattaaagtgcagattcaatgatatgatttagtttacaaaaaaattaacccataccgtatttttttaattttttacgcaatgtaccacggttaataccaagcattgtggctgcacgagtttggttaccgcgagtatgttgcataaccatatctaacattgggtgttcaatttcagataaaactaactcatataattcagttggatcttgaccatctaaatttcttaagtagttacgaaccgcttgttttacattttcacgaagtggtctatctacttgttgagcttgtgcatttaacattgatactgttaatgggttttgtgtcggttgttgttctaacattgtccttttatccaacttattaagattcttcacgaatcgattttacaaaatcttccaacgcctttaactgttctttcgtcgaatcaagggcattaaaagtacgtctaaaatttgcatttggtttaagctgttcgacataccagccaacgtgtttacgcgcaattcgataacctttttcttcaccataaaactgatgtaggttttcaatatgctgtaacattaattggcacttatcattaagtgataatgtcgaaacgagatctcctttctcgaaaaacttgccgatttccgaaaataaccaagggcgacctaaactgcctcgaccgatcatcacagcatcagcttgtgtatagtcaagaacctgttttgctttttccgcagaggtaatatcaccattggcaataataggaatcgaaaccgcttgtttaactgcctttatgctgtcgtattctgcttcaccttcaaatagacagcttctagtgcgtccgtgaatagttaaagctgaaatacccgcttgttcagctatattggcaatttctaggcaatttcggttctcaggatcccaacctgttctaatttttagcgttacaggcacatcaacagcattaacgaccgcatctaaaatacgggcaactaaatcaggttcgcgtaaaagggcagagcctgccatttttttgttcacctttttcgctgggcatcccatattgatgtcaataatttcagctccgtaagcgacattgatttttgctgcttctgccatttcagtgggatcagatcccgcaatctgtacagcattaataccgatttcgtgatgatgcgataaacgcaatttcgatttttcggtatgccatacatcagggtttgtggacatcatttctgagaaagttaaacctgcacctaattggctacacagtcttctaaaaggttgatctgtaatccctgccatcggcgcgaggaaaatacggttttttatttcatattgaccaattcgcatcgatttatccattgattatttttagtacaaatttaacctaaacgatatccaaataaaaagtacggtgtaaaaccgtacttcacaacctttattcagtgttcagcatcattatcgcctactaactcagggacgcgtataatacgcattttttcgccatttgggaagtctatttattcgacaatttaatgaaaatttaaaattaatcaaacaattgttatctataaaagtggtgaacgagatttattcgcccatttcatcactacattctcaatgctcgactcaatttgctctcccacacgttgcgataattttttcttttgttgatatttcacttcaatcacgtcttgcgattttaccgcatctaaaatgagatcatcactagtagagagttcatcaacaaggttaaattcaactgcttgttgcccaaaccaatgttcacctgtcgcaattttttctatgtctaactgaggacgatgttgagcaacaaattgtttaaacaagcggtgagtttcctccaattcttgctggaatttctgtttgcctttttcggtattttcacccacaaatgttactgtccgcttgtattcacctgctgtcatcacatcaacatcaatatcgtgttttttcaatagacggtgaatattaggtacttgagctaccacgccaacagagccaattacagcaaaaggggcagatacaatcttgttagcgacacacgccatcatatacccaccgcttgcagccactttatctaccgccacagtcaaaggaatggatttatctttcaaacgttgtaattgggaagccgctaaaccataaccgtgaaccacgccacctggactttctagctttaacaaaacctgatctttctctggttttgccaaagcaagtacggcatcaacttctttgcgtaaagcagatacaccgctcgcctgaatatccccttgaaagttcaagacaaacaaacgggatttctctgcctcagggttttctccgccctcttttaagcgtttcttttctgctttcgctttctctttttctgcttttttctcttgtttttctttatgctttaactcagcttcacttaaaaaggcacttgcaagtgctttttcttgttcttggtatttctcagttaaattagtcagcgtaattgagcctgattctggctgtttacgactttctaaaatcagcattatcacaacggcgacaatgccaaagaccgtcaataattccagcaaaaagataccgtaattaagtaagatttctttccacataatttgttctctcttatgaaatatgtttaattcttcccatctaatccaagcgcttgttagcctagtagcctaattcaatcggtaattcagctctaacccagccctcaaaaccacctttgacactatatacacgctcaaaaccttgctcgacaaggtattgagctgtattacgactactcaccccgtgatagcaactcacaatcacaggttcgtcataatcatattcatctaaaaacttgccgtaactatgatttgttaagtgaaatgcaccttgaggacgactatgactaaaccttaccatatcacgaatatccactaaaacagcgtcttcattttgcatcatttcccacgcctgttgtggggtaatttctgtaaatgtttcttccatattctttccttcattaaaaagtcggaagaatatagcattaaacacaaaattgtaaataaacaataagctattacagcagttgaaatttcaactcacttttatataataggaactattatcaaatgcgtatgcttctatacgcattttctttctttatatgataggaattttcaatggatcaactatttcaatttttacaaagctacatcgactatattatcttaggtttattagcgattatgagtgttattttgttcgctaaaatcattgagcgagttctattctataagaaagtagaagtcaaagattacgaaacattgcaagagttagaaatcgatctcactgctaacctcaccactatctcaactatcggctcaaacgccccttatatcggactacttggtactgttgtcggtatcttattaacattctatgaactcggtcattctggcggggatattgatgctgcctctattatggtgcatctctctttagccctcaaagcaactgctgtcggtatcttagtcgccattcctgcaatgatgttttataacggctttggacgtaaagtcgaagaaaacaaattaaaatggcaagcccttgaagctcgcaaagctaaagcctaagcggtcactttctgccaaaatttgacaagcgacgaggatataatgaaaaaatttgacgaaataaacattatcccattcatcgacattatgttggtgttattggcgattgtattggttactgcctcttttatctcgcaaggtaaaattcaagtaaatgtgccgaaagcctctactacacaagcaatgaaggctgatgaattggcaaaactgctcactattactgaaaataatgaatttttctacaatgataaaccgatcactaaagaagaactgaacgcagaaatagcaacttgggataaaagccaaaaggtgaccttgaaagtagatgcgaccgttgcttttgaaaaatttgttgaactaaccgaccttctggctgcaaatgaaatcaaaaatgtagcaattgtgacgaaaaaagagaatagtaagtaatgaaaaaacgtcactcccgtatcggattaatcggttctctcaccttacacggtacgctatttgcgacggtgtttgggattatccatactcaaaaaccattacctgcaacagaggaagtttccagtatctcaatggaaatgttggcggcacgtttagagcaagaacaagtggctgtggcagcggaagaacccgttgaggaagaagttaagaaacctgagcctgtcatagagcctgagcctattcctgaacctgttccagagccaccaaagccaaaggaaaaaccaaaagaaaagccaaaaccgaaagagaaacctccagtaaaagctattgaaaaaggtgctgaagctaaacaaggtgttgtagcaaaagcaattccgagtgcggtgcaaggtgcaaaaaatcaagagggtattgtaactggctcaccaaaaggtagtggcactgtaaatagtggctcagcaagtggtggggaaattaacgcttataaagcccaattacaacggacgttgcagcaaagagctaacaatgcttatcctcaaagagagaaaatgatgcgaaaaacagggacagtaaccttgtcattccagttatcgtcatcagggcaagtgatcaatgttcaagtgattaattcgtcagggaatagcaacttggatgcggcagcaatgaaagcggctcaaagcacaaaaatgcactcgcctcctccagcaggtttccctacatcgctaacggtgccggtgaagttttctgtgcaataatgcttgtctactatacctgctacgactttatgaaaataagagctgtaaagttaagtaactcataaatgataagtttttatccattagtaataggttttaatgtcaactctaatttttgttcaacaatattaaataataagtcaatattcgggtgtttccctggatgttgagttgcatcttcaacatgctcagcaaaccaaataattccttgctgagcagatttaacattcagctgctgactaaatctttctgcaagtgcattatacagttttaatgaacctaatttaccttcaatagcaggaatatggtgaatgatatttccttgtctatccaatatagataagcctgacaaatgttcaatgctagggaatgtcgctaaataatctttaaattgcattttgtttcctttttaactacataccaataataacacattccgctacactgcgagcattagataatgctgccgctgctttagctctatctccaactggaccaacaacaacgcggttccattcaccattgctattaatacgagcattgtaaccagccatagctaaacgggcctgcatattttctgcttgagctttatttttaaatgcaccacattgtaaaccaaattttccgacattcttaggttgctctaaagcaggctttgccgttgtaatattttttgcctgttcttgtgttttttggagtgcttcttgttttggttttgcttcactaacttcttgttgttgctcttgtttttgttctgttgctgtcgaggtatttgcgactggatcagatgttgctgtttggcttaactgctgctcttctttttgtttctgaattgccagttcttgctctttggttaattgtgctaatttagaatttttatccacaggaacttctctggtttctaaatctcgaatgtagctatatacctcctgcggtggggtcggcaatgtacttttaggttgctgtgatggtgccatttgtgtcggcattacaggcgtggttgggttgctttcttttaaaaaccagagaacaaacccacttcccatcaataataaaataatcactgctaagatcagtgcagtatttccaccttttttggctttagagcgaacagcataatcacgatttggcacaataacctcttttaaatccgatataaaataatctttaatcttactgaaaaaattagattttgactagtaaatcaaacgcccttgtttcacttcgaccacccgatcacaccacttacttacatcttccagctgatgtgtgaccattagtaacgtgagctgtttctgttggcataattccaccacaagttgttgcatttctattctcttttgcggatcaagggcagaaaagggttcatctaacaacaaaatcggtttatccctaagtagggttctagccaacgccacacgctgtttttgtccgcccgataataaatccgaacggcgttctaagagttcagcaatgcccatctgctttgcaatttgtgtaatctgttgcatctgtgtagcatcaaaatgcaaacgagaaactagccctaaaccaatattttgagcaaccgttaaatgtggaaaaaggttattatcttgaaataacatcgacacagggcgttgggctggttcagtagcaaaatgattttccccattgagtaaaatctcaccacgatccgctttttcaaaacctgctatcagattaagcaaagtgcttttgcctgcaccactttcaccaatcaccgcaatgcgttcccctttttttacattgagttgaaactgcattggcatttcagggtaatcaaattcaacatttatataaatcacgtgtgtatctcattaattgtattcaacattgtacatctcggtattgatactgctcactttgattattttggttccaaacaaaataaataacattaacattcctagaatgctttcaggaatacgaatcggtattaatgggctgagcaccttacccaagtaaagtagtaaaaatagtattgtaattgctatgataaagcgtaataatttaattaacatagtttaattcttttattttcttgcaattaatgtatacctacttataggaagtgcatatattaataatacaaaagctcccctaatctggagagtttttatgatttatttccgatatctttcttggtttttacgcattttaatgttgataaattccacaatcaccgagaagcccattgcggtgtaaatcgctgattttggaatagggatattaaagccttcacccattaatgcgataccgattaagattaagaatgcaagtgctaaattcttaatggttgggttatgatcaacgaaatccccgattggttttgcggcaaacatcatcacgcccacagcaatcataattgcaatcaccataacaggaatatcatctgccataccaactgcagtgataacagagtctagcgagaatacgatatctaaaacagcgatctggataaggatcataaagtaattcgctttcttacttgtattgccttcagtatcgtgtgcttcgcccttaaccgcttcaatcagttccattgcacttttaacgactaggaataagcccccgaagaataaaatcaggtcacgtcctgaaatcggcttatccataatcgtaaagagcggatcgactaatcgcatcatccacgctaatgaaagcaagagaagaatacgagttgccatcgctaagcccaagccgataatacgcgctgactggcgttgtttttcaggtaaacgagaaactaaaatactgattaaaataatgttatcaatacctagcacgatttctaacgctgctaaggtaaagagagcaacccacgcttctgggctggcaatccactcaaacatagaaagatccttgataaaattagacataacatcggcaaaaattgccgaactaaaagttgcacatcatatagagagctgtggcaaaattaaaggggcgcatgcaaaaaattttgtaaaatctctgcggtaaattgtttacgcaagtaaaaccctagtggcaatgattgaattttttcaccgtattgatttacggcccctgctaacgccttattatttcgcccttttggacgcaaatgaagcacttctcctaaacgagcattgatctcatttaaacgtccaagcacaatcagttccattaactcttcccagtcttgttgtaactgctgttcttgttgttgggacggcgaccataaaatcggctgtccgatatgccttttttcaaggggaattgaccgcttaccttcgactgggatccacaaaacccgttgcaatttatgtttaacatgtgacgtttgccatacaataccgtgattatccgttaaaggcgcaaggctgacaaaggtagtttctaacggcaatcctttttcattgacaggaatggttttcaactcaatgcctaaatgggcaaaatcttgttcaggcttactgccagcctttgcccctaacgccgtttcaataagcatacccacccaacctttatctcgacgtaaatcaggcggtacaaccatattcaacagttcggcaatttcccctagggtaaagcctgcgagccattgagctttggcgagaagctctgtttctgtggtggaatgggtggcaagttgcattgaagtgcgatctcttatgcgaaaataagcggtcacttgatcataaaaatttgcaaattttttatctgaaccgaccgctagttattcaaatataatgcttttcattttaccatattttactaacaatattttcattgagaactcttagtatttaagttgaaataaagtttgtaaaaaattaggggctgtcctagataacgactaaaagctctattttaggttaaaataaccaaatgagaaaaagtcgtctaagtcagcataaacaaaataaactcattaagctgtttgtggcaggtgtcactgctcgaacaacagctgagttggtaaatgtaaataaaacgacagcagcctattacttctatcgtctgcgattgcttatctatcaaaacagtccacatatggagatgtttgaaggtgaaattgaagccgatgaaagctattttggcggccactcgcaaaggtaaacgaggtcgtggagctgtgggtaaaaccgctgtattcgggcttttaaagcgtgatggtaaggtatataatgtcgttgtaccgaatactcaatctgcgacacttttaccgattgtgagtgagtttaatcattttcgtatcaatcacagtaacttaaaatcttaaatttccattttaaaacaattagttaagggcagcttaagttagttatctaggacagccccaaaatttatgaggaaacaaatatgaacaaaataaaaaaacttagtattacattacttgctagttgcatcttagtagcttgtggtggtggttcaagtggtggtcatcagcaagctgtagataaaacagaaaatcctattactaatcaacaagtaagtgaaaataacccccaatctttggataaaaataatgctagcaaagctcccgaagcaaaagaggataagcaaataaaagagccaattgttggtaagcaatctaaggaaaaaatagagcctccctctcaaaaattgaatgatcaagatatttggcagggcttctcgaaaaatggtggttattacgatgcgaacaattgggtgagtattacccttgaaggcaaagaaatcaagctagccccagtcaatggtagtaattcaaataatagtaaaatgaatacgttacgagatgccgatggaaatttggttggatattatggttatgcgacattaaataaaataaaagaaaatcaatataagcctggtgagaaagatgttgaacgcaaatatatggctttactagaagcgagagaagatgccaaaactcttccaactcacgatttatcttatcaaggaaaaatgtactatgctctcaaggatgctcctgaacaagctaaagaggctaatgttacagcaacctatagacatatgaataaatcaattttaattgatatttatgatgtgaatgggaacgatttaactactaataaaatagaagttagtgaaaatggttctattttcactcgtttatatttgaaagataaacgaacaccagcaggggaatttaaaggtggtttatatggcaaaagtggcgaaattttattaggagaagcgaaaaatgaggattcaagaccaaatacctctcaaaataattggaaaggagttattggtgcaactgctaccaaagacaaataatagtttctattgttaaaaaaaatgcttgtttgagcctctcccacaatttgtgtaaatacctgtttctgagataatacattcagacacaggtattttattatgaacgaaaaacaacttcacgccttggcagcggaatttgccaaaaacctaaaaacatcagaagacctcaatcaattttcacggatgctcaagaaaatcaccgtcgaggctgcgttaaatggtgaactgaccgaccatcttggttatgaaaaacattagcctagaaaaggtaaaaatgcacgtaacggttacacatctaagaccgtcatttgtgatgaaggtgagatagaaattgagacgcctcgtgaccgtgacggcacctttgaaccgcaacttatcaagaaaaaccaaacccgcatcacaggaatggatgagcagattattgccttatatgccaaggggttaagtaatcaggaaatcgttgaaatgttcaaagaactctatgatgcggatgtatcaaccagcctgatttctcacgttaccgacgcggtgaaagagcgcgtaatggaatggcaaaatcgcccacttgatgcggtttatccaattgtttacctagattgtatcgtagtttcagctttgcattgtgcatttagtgcgtaacagcttgaaattcgtttcgtggaaagattacaaagccgtcactgcagatttaaagcaggtttatcaagccccgacggaagcacaagctcgcgaaaatctgaccgcactttcgcaaaaatggcaggcaaaatacccgcttgtggcgaaaggctgggaagataactgggcaaatattgccacattttttgattatccggctgatattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccgttaagttgaaatgggtgtttacacagaatttgggatagggtcttataatacattaaccactcatctaaatcagcttgtaatgtcgctaaatccgtatatattttcttcctaaatgcgacttggtaaaattcttgtaagatagtcttatggaaacgttcacagataccattctgtctgtggatgcttcactttcgttttagtatgctctatgtcatttatcgctaaataaagctcataatcgtgattttccactttgccacaatattcactgccacggtcggtgagaatacgcaacatcggtaatccttgggcttcaaagaacggtaggactttatcattgagcatatctgcagcggcaattgcggttttcattgtgtagagctttcaaaagcaaccttgctataagtatcaacaaatgtttgctgataagtaagctggaaaatctaaggcaaattttacaaccgcttgctcaatgtgctcgtctactcgatttttgatattcggtacccgacgagtttgattaagtaatgcttcaacaccgccttgctctacggcttgttgatagcgatagaatgtatctcggctcattcccatcgctttacaagcttgagaaatgtttccaagttcttctgctaaattgagtaaaccagtcttgtgtttaatgagcggattgtaagtaataaaacatgagagtttccttttttgtttagattgaattttagacactcatattctaaacgggaaactctcatttttataatgatttgtcagatcaagtctgatcttctacaacttagcttataaaaaaataaacctaacctaacggttcattttatatttgatcgttagattaggttttattttttattttgagttaatactttcagtaatttgtgtcgttgataaatgccctggtacaacttttttaacgtttaattcagaatctaaaaaaacattggaagggtaacctctgactttggctcttttcagcacttcaccttgttcatctaatagtacaacgacatttttatagtccagtcccttataccattcaataaatttttcagttgatttttccccttttttatctggagaaacaatagtaataacttcaaaatttttattttgatcagcgcttaaatcatcaatttcagccaagccagccaaacaaatcggacaccaagacgcccacatttttacatagacattttttcctttatacttttctaaagaaacgatattgttatcgagatctttaaattgaatgtctgccaaatttttattttcttcagcaaaagcattaaagctaaatagcatgagaagtaagcccattatttttttcatcttatatttcccctatattacataaaactatgtaagttattagtgattaacaataatcccattaaaataattagtattccaccaatgattttaaatttatctaagtgcttgttaagtgatttagctctttttaataattcatcagaaaagaatgaaaagataataaaaggtagggctaaacctaatacataaacaaacatcattgcaccaccgtatagagcagaaccttcatcgcctgataatgctagcactgaagctaaaattggtccgatacaaggcgtccagccaagactaaaagttaaacccaatacaaaagcttctacagaagcgcttttaccatttgttttaatttcaactaatttagtttgttctaagaaattgatttttatgataccaagttgatgaataccaagaataataacaataattccagcaataacacgcgtagtatcatttaataataaatcacctaaaaagccaaaactaaaaccaaggctaacaaatgtgagtgataatcccataataaataggagtgtatttaatacctttttaccacctttacttaatatgccaaaatagatgggcacaattgggaaaatgcaaggagataaaaaagaggctaatccagctaaaaatacactgctgatgagtaaattctggtcgaacattttattttcctttgattaagttaattaaatatccataattttctttttccatttgctcaagaggaataaatttaatagcagcgctgttgatgcaataacgcaatccacctttatcttgaggaccgtcatcaaatacgtgacctaaatgagctttaccgctgcgacttaagacttccgttctaatcatattaaaactggtatctttttgataagtcaccacatttttgtcaattggttttgtgaaacttggccaaccgcagcccgaatcatatttatctctagaagaaaatagcggctcccctgtggtaatatccacataaagtccatcttttttgttatcccaatattcattactgaatgaacgttcggtattctttttctgtgtcacactgtattgtaaaggtgttaatttagcttttaattcttcatcacttggctttggataatctttaggatcaataataatattatttgcttgttctaaatcaatgtgacaataaccgtttggatttttctttaagtaatcttggtgatactcttctgctaagatgtaatgtttaagtggttcaacttccacttgaattttgtctttatatttcgtttgtagcgcttcaatttcttttagaataatagctttatcttgctcattttgataataaattcccgtgcggtattgtctaccacgatcatttccctgtttattcaggctagtcggatctatgacctgaaaataatatttaagtaatttttctaatgaaattttattagcatcgtaagttatatgcacggtttctgcatgatcggtttttccgataatatgataatgcgttttatcggttttaccattggcatagcctgacgtagcattttttacgccataaatacgttccatataggcttcaattccccagaaacagccaccagctaaataaatttcacgaatattctcattttgagtttgtgccattttactcatttccttacttgaattattagtataatttattgctagagaattattagatatagcagacataataagagtaaataatacagttttatgagatttcatatattctcctttgaattttctctaattctgaaataagcagtagaagtattggtgtgtaaatatgctactgcttgatttattagaattattttttagatagtaaattacatcttttcttttttcattttgtcagatttcatcatatgatcttttttcatatcatcagatttcatcatatgatcttttttcatatcatcagatttcaccattccatcctttttcataccatcagatttcatcattccatcctttttgataccatcagatttcatcattccatcttttttcatatcatcagacttcatcatatgattttttttcatttcagaatgtttcatattttccatagtttggcaatctgcgcccattttatttttgcaatcatccatcatttctgcatttgctgtattgattgtagcaatagaaactaaagaagttgtcattaatactttaagtaaagttttcataaatttttcctcttgtaaaaagatttgttaaggttaagataggttagtttttacgaaaagtttccctttcaccttattagtcggtgtaagagggaaatccttacaaaaatttttcattttttagaaaaatatataacactatgattttaaaagaaattaattcatctcaaatggcagcgattagagaacaaatgctaaaatttgctcatcttcagctacgagacagtcagttagcagaagatatggtgcaagaagcattgctcaacgcacttaaaaatttagatagttttaaacgtaatgccgcatttaaaacttgggtatttgctattttgaaaaataaaattattgactatctgcgtcaaaaagatcgtttagttcttgaaagtgatttgcgagatgatgaaaacgatagcaatgtattttttgatcaagatgggcattggcgagaagagtgttatccacaagaatggcaacagcccgaaaatgccgtttattccgatgaattttggattatttttgaactgtgtctcactaaacttccagcaaaacaagcgcacatgtttatgatgcgagagtatttagaactctctgctaatgaaatttgccatacagcagaaattagtcaagccaatctacatactttgttgtatcgttcacgcttacaattgcaagaatgtttatccagtaaatctatttttgggggcaaaaaatgaaatgtcaagaagtgacgaaattggtctctgaagctcaagaaagaccgttattgcttaaagaaaaaataggggtaagaatccatttattgtattgcccacattgtcgtaaatttgaaaaacattgccagcaaatgagccaattaatgaagaaatttgcagacgatcaaaataatgctgattgatgttttgtgtaataaagtagaaaaacaaaaacagcttgttatttttatgttagaatttctttcaatctaaaacaggagttcaaaatgggtacatttggttatgcaatgatagtcgttattgcttctttagctgtagaagatcaaatctaatctgacagtccccgtttaaaattaccgtgtctgtcagattaatttgagcttaaattcttttctgcccaaatcccttttccattaagtaatgttgccatcagtgttctgccacagcacatttttccttgatgtgttcgatggtgattataatacattaaccactcatctaaatcagcttgtaatgtcgctaaatccgtatatattttcttcctaaatgcgacttggtaaaattcttgtaagatagtcttatggaaacgttcacagataccattcgtctgtggatacttcactttcgttttagtatgctctatgtcatttatcgctaaataaagctcataatcgtgattttccactttgccacaatattcactgccacggtcggtgagaatacgcaacatcggtaatccttgggcttcaaagaacggtaggactttatcattgagcatatctgcagcggcaattgcggtgttcattgtgtagagctttcaaaagcaaccttgctataagtatcaacaaatgtttgctgataagtaagctggaaaatctaaggcaaattttacaaccgcttgctcaatgtgctcgtctactcgatttttgatattcggtacccgacgagtttgattaagtaatgcttcaacaccgccttgctctacggcttgttgatagcgatagaatgtatctcggctcattcccatcgctttacaagcttgagaaatgtttccaagttcttctgctaaattgagtaaaccagtcttgtgtttaatgagcggattgtaagtaataaaacatgagagtttccttttttgtttagattgaattttagacactcatattctaaacgggaaactctcatttttataatgatttgtcagatcaagtctgatcttctacacataaagttatattccctttcttttttagtttttttaaagttatcttattttcattagtttctaaaacagtttcttctatgacaactttttgtcccacattaggatgtttatcaatagttgaagataaatcaccatgatttgtcacttcatcaatatcttccttaggagttgttgatttattggttttattatcagcatcttctttttgctttatttccttttcaatgtcaattccatattctcttaatttatcttttatttcattattatcatctaaaatagattgtatattttttcttttattttcactgacaatgagttccttaataaacttttcttttaaacttggatctttcatgatttcatctaaaacagcttgattttcattaaataaagttttaatgacctcagtggtgctttggcttggtttttctagatataaagctcctaacatatatgtaatatactctggatttatcttttcctgattttttacactctggctaattgagtataagtgttgaacagcatcagtttcccaagcccattcttttttcattatttctttttgtttatcatttaaagatgggttattatcaattaattcagaatactcttttcttatttgataaatttcttctaaatcttgaattttactaatatctttgtatttggttagagtattaaataatttttgttgaagttcttcaattttctttttaaattcttcatctgaaagtttattgtgctgattagcaatagcagcagattgaatttcaatctgagtatttttagcatcttctttatcttgattattcaagttagaaaatagtttctcattttcaacaaactcagaaaattgctctatacctgatctaaagctttgtttttcttgattggataaatcattccagctcatcccaaattggttaaataacttgtcatataataaataattatgatgataagatgaattttcttttaaattattctctttattttgtttttcttcttattttttttgatttgaatattttgataaacatttacttctttgttttgatatgcagatttaaaatattgcttctcttttgcctcttctttgatttctttctcaataaaatcagatttcaaataagttttataatgtgggttttcttgaagtctgttattgatttttaaagcagtaaatctgtgctgtggattagatgaattcattaattcatgagcaaagctttctaactctggaaataatttaacatcattaatagcagataaattaatattatttattatctctaatatagaatctttattaatagccattttgattaaaaagtaaaataaaactaactaattttattataataaaaaagctaataaaatagcaaaaacacaccaaatgaatcaaaatttcatatttgtgcttttcctacatagttatggggagatgcactgttgaatttttatccaaagttcacgtttctgtttggggtcggaaagtttttgccaagactcacactgccaagcggtctgatttgcaaatttttttgcaaatcgcaccgcttgcgcttcggattggattaaccaaaagattggttgatgatcgaaccgtaagcgcattgcctgctcaaggctaatccattgatattgctcgtgatttaattgtaatgcccgcaaaatatcttgaaacaaccctgtttgttggtgatctttttcacaaacaaccactagcttcaccgtatccgccaagcgaatttgtgcatcgcctttgagtacttgcggtttaacaagtacccattggggtatattcatttctgttagaagtagatcacggcgattcatcatttttcctcataaaagttggggaatagtagcaaaaatcggtaaaatgcagaaattattttgcattaaatttggaaatttaagcaaaacaataattattgatttaatgtatcttactggatacaattgaatgggctagataatgtagagataaagcgatgtcaggaattatcaaccaaatcgtcattacagataatttttcaaagtggctagatggtttaaaaaatcctattgctaaagcaacagtggcaagaagaattaagaatgcagtaaaaggtaattttggtgatcataaagcgcttgcaggtactggtggactttatgaaatgcgaatagcgacaggcgctggttatcgaatttactatgcacagcagggcgatgttatttatattctgttacaaggtggtgataaatcaacactgcaagccgatattgagaaagcgaaagcattgtgggcagaattaaaacagacaggaggaagtaatgaatattaatgaagaaatggcagaaaaacacggtttacgtccttttgatgtcgctgaatttttggataacgaagaaacaatacaagcctatttagcagaagtattaaaagagggcgatcaagatgagtttttggaagcccttaatgatgtagcaagagcaagggggatcgcagaacttgcgaagcaaacggggttaggtagagaaagtttatataaaaccctatctaaaggaagtaaacctcgttttgaaactattcaaaaaattttaggagcatttaatcttgtgcttctcccacaaataaaaaatagttaatccggtaagacatagaagatttaagaatatgtcgatctgtttcaaattcaatttaaaaaatttttaaaacaaatgattacaaatgaaagcgaagtgcttgaacgccacttgagcgtctttgagcaaaaaaatgtattgttatttggcgatgtgcgtgatgatttttcgggactcattcagccgatagcaaagtctgtggcggcgttcagtagctattttgattatgctcgctattataataacgtggaatttggcttggaatgttatcagcaagcagaattagcagtcttttactggacgaagaataagcaagagtgtcaatttcagttgttacaatggctggcaactgcgtcagttggtcaagaattattggtgataggtgaaaaccgtgtcggcgtgcgttcagtggaaactttgcttgaaccctttggtgagatagccaagattgactcggctcgtcgttgtggcttgtaccattttagactggaaaatgtgcctacttttgatagcaaaaaattctggaaatcttaccgcttgggcgatcttgatgtgtttgcgttacccgcggtgtttagctcggcagagctggataatggttctaaattgttgctttccaccttccataaagcagatggattaaaaggaaaagtgttagatcttggctgtggggctggggtgattggggcttgcttaaaacaacaatttcctaaaatcaagctgacaatgtcggatattcacgcaatggcattggcatcaagcaagcgaacattgacagaaaatcagctggaaggggatgtggtagcaagtgatgtcttttcccatattgacgggcgttttgatctgattgtgtcaaatccacctttccacgatggtgtagatacagcataccgtgcggtagaagagttgattgcacaagctaaacaacatcttaatcgtggtggtgagctacgcattgtcgccaacgcttttttaccttatcctgatttattggataaagcatttggcagacatcaagtgttagcgaagtcgagtaagtttaaggtgtattcagcgagagtctagggcgtgttgatcttttaagtacaaaaaacaaacgacatagaaattgatctgcaccccaaaagttggactaaacaaccaactaattaaggtgcagatttttatggctaaatacacccaatcttttaaacaacaagtgatcgaattttatcttcaacataataaaaatcgccattaactcgtcagcattttcaggttaaggaaaccatattgagatattggattaatcagtataatcacaatggtatcaatggattagctgtttgccacagcaaacgagtttactcatctgagtttaagttatctgtaatacaagcggttaaacaaggtcaattttctactctgcaagcagcattacattttggtattcctaattgctgtgtcatcagccagtggttgcaagcctcgtgaaagaactgcgccaccaatttccgtttgagattttattgcaattggttgatttaaaacggagtacgttcttttatcatcttgctgaaaaagacaataaaaatgcagcgattgagcaagaagttatcaaaatttatcacaaaaatgacggtaattacggttatcgccgtattacgctggaattaagaaaaatatagctgattaaccataaaaaagtccaacgcttactgcaacaacttggtttgaaagggaaaaacaaacgcaaaaaatatcattcttatcgtggtgaagtcggcaaaattgcagataatttgctaaaacagaattttcacactacagccccaaatcaaaaatgcgtcaccgatgtgagtgaatttaagtgtgcagaaggtaaactttatctctcgccgattaaggacttgtttaacggtgaaattattgcttatgatgtggcaagaaatccaagtttcgagcagataagccgaataatgaaacgagctgtagcaaggcttgacggagcaacgccgatactctattctgaccaaggttggcaatatcaaatggcaagttatcagtcgattttgaaacaaaacggcatcgtacaaagtatgtcgagaaagggaaattgtttggataacagtgcaatggaaagtttctttgggcgtttaaaaacggaatgttactttggtaaacggtttgagacctttgagcaactggaacaagctattcacgaatatattcattattacaatcgtgagcgtattcaagtaagattaaaaggactaagccctgtggaatacagaactcagtccttgaactaaatcagtctaactttttggggtcaggtcattttgaccgcttgcgcctgttgaatgctggtgagccttgatgacactgcgattaataaaaatccattcagaatcaatatgttgtctaaatgattttagcacttcttgccaaacaccctttttagatcaaagattgaaccgacgctaaatcgtgttccacaagccaaattcagcaggtaaatcacgccaagggcatcccgtacgaatgcgatataaaatcccttccactgtattacgatgttcaggtttattataaacacgtcctgtacggtcaagtaaataagctaggcgtttccaaagattatctgttaaaatagttctaagcgacatagtttgtatgggatggttaggttttggcgaactaaattataccaaatttctatgtcgtttgttttttgtacttaaaagatcaacacgccctactatgccaacaaaaatatcggcatagtagacaaaatggccactaaaaagtggcttaaagccttatattacaggctttaagccactttttttgaattatgaacccaaaaaatgtcatttttgccacagtagcgacattcgcaaacatggtataagaaataatattcaacgctataaatgtaatgcttgtaataaaacatttacccttaaaaagaaattaaatccaccactatcacgtgatttaaatattattgcggataccagcttctttggtcgtcaatttggtattttactcctgatggattcgctttctaaaaaagtggtttaccatcgtgtcatcaaaacggaaaaagatgtttattacagaatagcatttaattcacttcgtatgaaaggccataacattcaatcaattacctgcgacggcagacggggtatattgaaagatttattggatacaccgacgcaaatgtgccattttcatatggtagccattgtgatgagagcattacgaaaaaagcatcaatctatagctggaaaagaattaaaaattattgcattgactcttaaacagagttctaaaaaagacgtctatttacgattacatcattggtatttaaaacataaagcatttttagaagaacggtcagataaaccgaatgaaaagggctattatccttataaacatcggaatgtaagaagtgcttatgccattttaatacgtcatatggatgatatttttacctatgaaaagcatggcgatttaaatatcgaaaaaacgacaaatagacttgaaaacttatttgggcaactaaaggaaaaattatcgcatcatacaggattaatgaaaaaaacataacattatgtttataaaggattttttaaataaaaagagttgctaagaataattaaaatattcattagcaaccactttgtcatataggcatagtttttgacgaattaacaaccattttatctactatgcccttaagataacaatctaatcttcttaaactaaaaatagattatttgatgattttcacaacaacaccagcaccaacggtacgaccaccttcacggatagcgaaacgtaaaccttcgtccattgcgattgggtgaattaagcttactgtcattttgatgttatcgccaggcattaccatctctacgccttctggtaattcgatagtaccagttacgtcagttgtacggaagtagaactgtggacgatagcctttgaagaatggagtatgacgaccaccttcttcttttgataatacgtaaacttctgattcgaagtctgtgtgtggagtgatagaacccggtttagctaatacttgaccacgttcgatttcttcacgtttggtaccgcgtaataatgcaccaacgttctcacccgcacgaccttcgtctaataatttacggaacatctcaacaccagttacagttgttttagttgtatccttgataccaacgatttcaacctcttcacctgctttaatgataccacgctcaacacgacctgttactactgtaccacgacctgaaattgagaatacgtcttcgattggtaataagaaaggtttatcaatcgcacgctctggctctggaatgtagttgtctaagtggtttgctaattcaagaattttctcttcccactctggcacgccgtttaacgcttgtaacgctgaaccacgcacgattggtgtgtcatcacctgggaagtcatattgtgaaagaagttcacgaacttccatctcaactaattctaataactcttcatcgtcaaccatatcgcatttgtttaagaatacgatgatgtatggaacacctacttggcgacctaataagatgtgctcacgagtttgtggcattggaccatctgttgctgcaactactaagattgcgccgtccatttgtgccgcaccagtaatcatatttttaacatagtccgcgtgtcctgggcagtcaacgtgtgcatagtgacgagttgctgtgttgtactcaacgtgtgaagtgttgatggtaataccacgcgctttctcttctggtgcgttgtcgatttggtcaaacgcacgcgcagcaccaccgaaagtttttgcaagaacggttgtgattgctgctgttaaggttgttttaccgtggtcaacgtgaccgattgtacctacgtttacgtggactttatcgccacgattaaattgttctttagccattgtaaagtttcctttgttgatgaaatcccatagcacgatatgcaccacagggtttagagtaaagacctattatattgccatttatgttatttatgaacttattttttaaacgatattggtttaaaaaagtccagttaaacaaatatggtcaagatggcattctaccacattaaccaaatttagaaatcaaatacttatttatactaaggaaaagatgaagatagaaagtaatgaagtggtgctgataggcggatttgaaccgccgacctcacccttaccaagggtgcgctctaccaactgagctatatcagcgtttggagcgggcagcgggaatcgaacccgcatcattagcttggaaggctaaggtaatagccattatacgatgcccgctgttctaaattcgtctgtcccaaagaaattcaattaaagaaatggtggagggagaaggattcgaaccttcgaaggctgagccaacagatttacagtctgccccctttggccactcgggaatccctccacgataattgaatacttgataacgctagaatggtgccgactaccggaatcgaactggtgacctactgattacaagtcagttgctctacctactgagctaagtcggcgttgcgtcgtaagtaagtgaggtgcattatagggatttcgaaaaaccttgcaagtatttttttcaaaaaaattaaaaaacccactctttcgcttgttaaatatgcaaagtgctgattttttagatgtttttgctcaatattgtaagataaaatagctacttttattatttctattgtatatttcgggttattaaaaccgtcgcaatataaattatattcagcaaaaatagagaacttggcaatgggcatcactaaaattacgccttttttaacgtttaatcgtcagcagtgggctgcattacgaaagtcagtgccgttaaaactgaccgaacaggacttaaaaccacttttaggttttaatgaagaactttccctcgaagaagttagtacgatttatcttccacttgctcgtttgatcaactattacattgatgaaaatctcaaacgccaagaagttttacataagttcttagacgtagaatcgccgaaagttccttatattattagcttaacaggcagtgtttctgtcggaaaaagcacttctgcccgtatcttacaagccttactttcagaatggcctgaaaaacgtaaagtagatttaatcaccacagacggcttcctctatccactaaaaacgctacaagagcggaatttaatgaagagaaaaggctttcctgagtcttatgatattcatcgccttattgaatttgtttctgatattaaatcgggcaaacgcaatgtcaaagctcccgtttattcacatctcacttacgacatcattcccgatcagtttaatgaggttgatcaacctgatattgtgattttagaagggctaaatatgttgcaaagcggtatgaactatccacatagcccacatagcgtctttgtttccgattttgttgatttctcgatttatgttgatgctgatgaaaccttattgaaagattggtatatccaccgcttcttaaaattccgtcgcagtgcattctctgatcctcattcttacttccatcactactcaaagttaagtgaacaagaagcgatcgcaacagcctcaacaatttgggacgaaattaatggattaaatctacgcaaaaacattttgccaagtcgagagcgagcaaatttgattttggtaaaaggcgaagatcacgccattgaaaccgtcaaattaagaaaataataatgagtggctttcagttcaaacagtttttcattgagcacgaccgctgtgcaatgaaagtcaatacagacggaattttactcggtgcaatcgcagatcctagcaatgcacgccaaattctcgatctaggcacggggacagggcttattgcaataatgttagcccaacgtaccgctagtgcacaaattactgcacttgaactggaagaaaacgcgtttcaccaagctcaagaaaatgcccaacattgtccgtggaataacagaattgacgtactacaagcggatataatgacgtggaaatctaccaaaaaattcgaccttatcgtatcaaacccaccctattttgagcatggcctcgcaagccaaaataagcaacgagatattgcaagagctgtgacttatagtcattttgattggctaaaacagtctcaacagtggctaactccgaatggcagaattagctttattttgccttgtgatgctggaaaaaaattgttggaacaaagccatttattagggctatattgtattgaatactgggaaatctgcacaaaagtcggactatcacctaaacgagttatcctcactttttcaccacaatatgctgaaatggctttgcatacattgacgatttatgatgaaaatcagcgatatactgctgactttactcagttcacagaaatattttacctaaaagtaaactctaaataatagatatgtggtaagtacgtatctatatgatacacataactagctctaaaattcccttgaaaactttcttatgtgcaccatatgatttaattttcacttcaccaacccaccgcttgcttgtaaatctgcgtggtaggaagagcggacgaaaggcccacaggcggcgtgttcaaagcccatttcgttggctttttcacggaacatatcaaattccgttgggtgaacgtaacgtgccacgggtaaatggtggcgacttggttgtaaatactgccctaatgtcagcattgtgacaccgtgatcacgcaagtcttgcatcacctgtaaaatctcttcgttagtttcccctaaaccgaccataatgcctgatttagttggaatatctgggaaaaccgccttaaattctttgagtagtttgagcgaccattcataatccgcacctggacgaatttctttatacaggcgtggcacgttctcaaggttatggttaaatacatctggcggattttcttttaaaatttcaattgcttgttcaacacgaccacggaaatccggcactaaaatctcaattttaatccctgggtttaacgcacggatctctttcacacattccgcaaaatgccctgcaccacgatcaggcaaatcatcacgatccacagacgtaatcaccacatatttgagcttcatatcctgaatggtttccgccagtttcttcggctcgtctttatctaaaggcaacggcttgccgtgagccacatcgcagaatgggcagcgacgagtacaaattgcacccataatcataaaagttgccgtgccgtggttaaaacattcgtgtaagttcgggcaagaggcttcttcgcacacagagtgtaagccgtggcgacgcataccgtttttgatactttcaatttttgctgagttggctggcagtttaatcttcatccactcaggttttttcagtaattcttggttgggatcgatatttttaacgggaataatagacgttttagctgcatcacgatatttcacgccacgttccattttaaaaggtgtacccattcgataattgtcctatttgttaataatttgttgcttattatagccgagaatttgggtaaagtaatcgaccaatttaggcgaaaccttgtcacaatcggcttcagcttcagcgacaaaatcagctaattgacacatttccaatcctgcatagccacaaggattgatattgcgaaacggtgttaaatccatctggatattcaatgccagtccgtgaaacgaacagcctttgcgaatgcgtaaaccaagcgaacagattttcttaccgtccacatacaccccaggtgcgtctggtttgggataggcattaattccataatcagcaagggttttcactacacattgttccaatgctgtcaccaaatctcgcacgctcaaatcgttaccttttgccttgtggcgtttgatgtcgatcagcacatacataatttgctgtcctaaaccgtgataggtaatctgcccaccacgatccgattgtaccacggggatattcgttggattgagcagatgctcaggtttacctgctgaaccttgagtaaacaccgacgggtgctgaaccagccaaatttcgtcggctgtttgttcatcacggctatcggtaaaatcctgcattttgtgccaaatttcttggtaatcttgcacaccaagttggcgaatgataagttggggcataggttataactgttttatccgttgtctaataatctgttcaagcaagctataatcgcagcgctgtgatttaatggaagctttaatattttcttcggggcttaactgaccaaaatgtatttgatagccagcttgtcgagcaagtaatatcaaaaaagccctttgcgtcctgccattaccttctctaaaagggtgtaacatattgagttccccccaatagaaagctaaacgctgaataaatggctctaatgccagttctcgcaaatagttctctgcttttagttgagcaaagagtttattcgcttcaggttcaattcgcaaaggtaactcaaacatagaggaacctttactgattgagattgttctcaactcacctgcccactcatagacttcatcaaataaaaatttatgaatcgcctttaaatgtgctaaatcaaattttccttcgatctgtttttgtaacaataaggtcagttttcgtagaacaaaaatagtttctgctagctcaagctcttcttctgtctttgccccaagcttattttttaagacaccttcttgattaagatagggatctcgtccgctcccatatttcatacgctgactccattaactgtttatcattgatttcccctgctaaccaagcagacatctgttccagattttcttgggttggagataaaaattctaacgcaaatgaatcaactgcatcctgtagagcttggctcttacgttgaaagagtgtcatttcattcctctgattttttattacaacaccattctcacgccttcaattttggctaagtcagtatagagtgtttcgacttgttcgatattttcggcttgaatagtgatggatacagagtgataagtgcctttgccgctctctttaagagatggattatagtcgcctttaaccactttttgcacttcgctaacgacatcatcgattaaaccttcacgagctacacccacgactttaaaggtgaacgagcaaggaaattcaagtaaatctttgagtttttgttgtggaatatcggctaaatttacgctttttgtttctgtcattttattgtcctttatgaatatgagagcggtgtgattttgcaaaaaatttgcaagatcgcaccgcttgtttgaacggcacactaaatgaagacaattctgataattacaagggtttaattaaacagacctttaaccgttaaaacgatccaatcccacgctttgccaaagataccagcttcttgaacatcgtgcattacttgtaaatcaacactcgccacatctttgccattgagttgataaatcacttttccaacgacctgccctttcactaacggagcttccaaatttgttttttctagggtgtagcgagctttaagttctgctgttttaccttttggaacggtaatgtaactatcttgtaatgtgcctagttgagctttgcttaaatcaccataatacaccgcttgttcaagcacgctttgccctgctgaaagtggtttgacagtttcaaagttagcaaatccccactgtaacagttttttgctttccacttcacgccctttataggttggtacgcccataaccactgagattaaacgggtattactattgtatgctgaggctacaaggttatagcctgcttgatcggtatgtcctgttttcattccatcgacattgatggatttatcccacaataagccattgcggttaggttgggtaattttgttgtaggtaaactctttttctgaataaattttgtactcttcaggcaagtcacgaatgatatgagcgccgataatcgccatatctcttgctgatgagtattgttctgggtggtctaagccgtgaactgtcgcaaaatgtgtgttctttaaaccaaatttctgcacaaatttattcatactatcaatgaacgtttgctctgaacccgaaatatgctctgcaatcgcaacacaagcatcattacccgacacaacgataatccctttgttcaaatcttcaacagacacctgctgattaacattcaagaacattttagatgagccagggaatttttgtccccaagagttttcggtaacggtgactaaatcgctgtttttgattttacctgttttcaaggcttcaccaactacatagctcgtcatcattttggttaaacttgcaggtgcttggtgttgatctggattaagactggctaatactgcaccagaattgtaatccattaaaatataggtttgtgcattaagttgaggggctggaataccataatcaatatcttgagcataagccatattcatacttgaacaagcaatagcacatagactgaccgttttgagtactttactttttaacatataaaaatcctatctatttttctgaataactgaatacagtgtaacctaaacggttgagctgctgtttaacttgttgagcttcttcagctgaagaaacatcaataatcacttcatatctcttttctttcgtgacaatgtggctattcactgtcgaaatcactttctgtacttttttcgccatacgttcattcttaagttgagtgacctttaacacaaattttggctgagaaacaaccgcttgcggtgtaggttcggtatcggctttaatggcaagtgtttcaccatcccctttcactttaaggttcaacccttcttgttgtgcaatttgatagagtgcttccgcccctttcccgataatatagccttctttatctacctgcatagcttccactcgtacttttgctgtaccagccctcaccataccaatcactttagcagcacctttagataaatcaataatgagagttttactaaatggcccacgatcattaatccgtactattacttttttgccattgcgtaaatttgttattaaagcataagatcccaaagcaagcgttttatgagcagcagtataaccatttttatcaaaaatctcaccgcttgctgttctgcgtccgtggaatttatccgcataataacttgcagttccaacttcgctgtactggcgagaagcttctttacccattaccttatgcgttgtccccttctcttgataggatttttgattatttgatattttaacgcgttctaaatctgctccttttaccccataaagtttttttgtttgattatcactaggaacggttgtttttgtacttttagtgttagatcttacagctttcttctttacctttttcttagatgctactttttttgtcgattttttctttacgataagctgcgttttagttgcttgcttctttgtatttgttgccattgtttccaatggtgtaaacattatcattgcagctaataatagcgtaacaattttgcctattttcattaaattccccttttaatcatagaatatttatttttctgctaatttatatggattacttttctcttttagttcacgatgaacataactcgacatcattaacccaaaagctgccattaaggtaacataagaggttccgccataactaaacaacggcaatggaacgccaactacaggtaaaataccgcttaccataccgatattcacaaacacatatacaaataataagagagcggttcctcccgataaaattcgtccaaaggctgaggcagattttgccccaatcattaatccccttgcgataataaataggtaaatagctaataataccaaaacaccaattaaaccaaattcctcactgagtaccgcaaagataaagtccgtatgcggctcgggcaaaaaatctaactgagattgcgtgccttccatccaaccttttccttcaataccgccagagccaatagcaattttggattgaatgatgtgataacctgttcctagcgggtctttatcgggatcaattaacgtcattacccttgtcttttgataatcgtgcatcaaataaaaccacattatcggaataaatcctgctagaaagacaataccagccccaataagtttccaacttaacccagcaagaaataaaacaaacagcccagcggcacaaactaaaatagaagtacccaaatcaggctgtattgcaactaataatgttggcgcaataataatcgccagagcaatactggtatcgcgtagatttggcggtaaggaacgattacctaaatagcttgccaccattaacggtacagaaagtttggcaatctctgagggttgaaatcgaataaatccaagatttagccaacgttgcgcgcccttactgatttcacctgacacatcaaccaaaatcagcaaaataatacaaaccacatataggtagggtgatactttttcgtaaaaacgaggggggaacatcgccatcacaaacattacccctaaacccagacacacttggattactcggttggtaaacattttttcactgccaccgcttgcactatataggactaacaaaccatagccagtaattgccagcaagccgattaatagccataaatctaaggcaaagatcttcaaaaatcgtcctaaaaatgatgatttattcactcaattcctctgcttctgtttctggggggcacgttcttctacaggcaatggtgctgtagcttcggtttggtgtaacaatgcataatccataatctgtcttgctatcggtgctgcggtactaccgccaccacccgcattttctaaaataatggaaaccacaattttaggattatcatagggagcatacccaataaaccaaccgtgatcgtgtaaattcttttttaaacctttggcatcataactctgtccgtttaaactaaagacctgagctgttcctgttttacctgcagctcgatacgcagtaccagcaaaggcttttcgcccagtaccgttgctcgcattaattacgttatacataccctgttttgagatctgccaataacggcttggcacatcagaaatatcctcgtataacaacggatctttataaggaataagctcactcgacattatctctttcatcaagtgaggcgtattcactcgcccattgttaatcagcactgccgttgcttttgccaactgtaacggtgttgaaatccaataaccttgcccaatgccgacagaaatagtatccccttgtaaccaagattttctataacgtttctgtttccactcacgacttggcataattccgacggactcttcagccaaatcaatccctgttttcacgccaaagccgaattttttcatccaatccgacatcttatcaatccccatatcataggcgagttgatagaaaaacgtatccgacgactcgacaatcgccctattcacatcagttctaccgtgccccccttttttccagtcacggaaacgctgtgtagaaccaggtaaaatccaaaaaccagggtcataaattgtcgtgtttggagtaatcttaccttccgttaaacctgctactgccataaacggcttaatggttgaagcgggtggataagtcccttgtgttgcacggctatacaatgggcggtcaggatcttctaacaactgcttataatctttacccgacaccccatcaacaaacagattattgtcataacttgggtttgtcaccatcgccaaaatactgctgtctgtcggatccaacacaactacagcccctttttgattatccaataaatttgccacatagcgttgcaaatcaatatcaatgctcaaacgaacactgcttccagccactgcaggctgatcacgcaatttacgaataactttaccacggttattaatttccacttcctcaaaacctgttacaccgtgtaactgctcttcataaaatttctcaatacccagtttcccaatatcgtgcgaacccgcataatttccgaacttaccttcctcttgtaaacgtttcttatcccgatcattaatcttcgcaacataaccgaggatatgggtcaaaatatccccataaggataatttcgcttaaaataagggtgaacgtccatacttggaaaacgatattgattaaccgcaaaacgagccatctgctcttcggttaaatcaggctttaataaaatcggagtataacgagttgtccgttttttctctttatgaaagttctcaatatcttgatcggttaaaccaaccaataattttaattcttcaagggtctgatctaggttatcaatcttctctggcacaatatacaaaccaaaataggttaagttttcagctaaaaccttaccgtttcggtcataaatcagcccccttgtcggaggcacaggcaataacttaatccgatttccatcagaacgagtttgataagaggcataatcaacaatttgcaaatgataaagatttgtcagcaaaatacctgttaaggcaatcacccccacaaacgcaatcaaggcgcgacgtacaaacagatttaactctgcttgcccgttacgcaccttgtcataattttgcggttttgcgaatttaccaaacatttgccattattctcgatgataagggtgatttgttgtcaaagaccacgcacgatataaactctcagccaccaccacacgcactaatgggtgaggcaaggttaatggcgacagcgaccaactctgctctgcagccgctttacattcaggtgaaagcccctctggaccaccaatcaatagacacacatcacgcccatcattcttccagctctctaactgctgggcgagttgctctgtcgtccaaggcttaccaggaatatcaagggtcacaaccttcgcacgcccacaagctgccaacatcgccttgccttcttgctctagaatacgtttaatatccgcattcttaccacgcttacctgcagggatctcaatcagctcaaaaggcatatcttttggaaaacgacgctgatattcctcaaaacctttggtaacccaatcaggcattttagttcccactgccactaattgaattttcatctacacccaaagtttttctaattgatacatctcacgactatcttgttgcaaaatatgcgcaatcgcctgcccaaaatcgaccacgatccagtcagcaactgctttcccctcgtgagcaaacacttccacaccagctttcttactttccacaatcaaattatctgcagtagaagcaacgtgacgacttgatgtccccgtacacacaatcatcgtttcagtaatgctcgatttccctcttacatcaatcgcttgaatatcctgagctttcagcccttcgagggtttctgttaaaaattgaactaaatttatgatcatatcttctattcagtctatcaaaaattggtggattatagcatataaaaggacgcgatcaggaaaagtaatatgtttacaaaggtttcataagtatcacctctcttatatgatgatttaactatttacctgtaatagcaagtatctacttctcagtatttaagaaagtcataatataaatgcccacactatctcattaacacttaatagaaaaatcctattacagatgcatgaattttaaacgtacaacaaccattattaatatttttatttgacagttaaattaaattaattagaatagggtaaaaaagcattatgacacataatgacttactctacgcgggaatagctcagttggtagagcacgaccttgccaaggtcggggtcgcgagttcgagcctcgtttcccgctccattattgtgcccgagtggcggaatcggtagacgcaagggatttaaaatccctcgcctttcggggcgtgccagttcaagtctggccttgggcaccatgttaaatctctttgagaaattctgttaaaaaatcacttaattaataccccgaagtttgaaaattacccctagttatttccgaagaggttttaatgctctttccgacactctcgtctggcatactaattcaacgctataaacgtttcttagctgatgtaaaacttccaaacggagaacaaatcacaattcactgtcccaatactggagctatgactggttgtgctaatcctggagacattgtttggttttcaacatcaaataacctcaaacgtaagtatgcctatacttgggagctcactcaaactcagtcaggtgattttatttgtgtaaatacacatagagcaaaccaacttgtttctgaagcattaaagaataaatggatccgtgaactcgtagattacgatgaaatcttacccgaacagaagtatggtcaagaaaatagtcgcattgatttcctcttaaaacaacaaaatttgttggactgttttgtagaagtaaaagcaactacgctactcactgaaaacggtattggaatgttccctgatacaaaaactgaaagaggacaaaaacatctaagagaattgatagcaatttcccagcaagggcaacaggcagtcattttttttgctattttacatacaggtattaaggcttttgagatagctaagaaaattgatgcaaaatacgctcaaatttttaaggaagggatggataatggggtaaaaatgttggtatataaaactgaaatgcttttctctggaaaaacaccaacaggaatagaattaatcacccctttaatttagacactctaaactatttttttaaaatagcattaatcgcattcgcatagctttcagattttgtgccaaaaataacgtgtacgttattttcaacaatttgtaccacttctgcggcaccaagtgcttttaagcctttgcggtcaattttatcttttgatttcagttgaactcttaatcgtgttaaacagaaatcaagaaattctatattttctgcaccacctaatgcggcgataattttaggggcgatttcatcgacagaaagagaaagctctaccgtttctttttctgagttaaacaggtttttaataaatttgaacatagcgaactcctataaagtgaaatataaacagcgtatattttagacctaattatgataaattctattcattttacaaaaatcttggttaatattaccgcttacacttgaaactgatgatattgcccttaaatatgcacgcagttttttagaaaaataggaatttcaatgacaacgattgtatgtgttcgcaaagatggcaaagtcgctatcggcggtgacggacaagcaactttaggtaattgcgtagaaaaaggtacagtgcgtaaagttcgccgtttatataaagataaagtggtaacaggctttgcaggctcaacggcagatgcctttattttgcgtgatctgtttgagaaaaaacttgaattacatcaagggcatttagtcaaatctgcggttgaactcgcaaaagaatggcgtaccgagcgttcacttcgcaaattagaagcgatgatgatcgtcgcaaacgaaagtgagtttttgctggtttcaggtagtggtgatgtaattgagcctgaatttgatgtattagccatcggctcaggtggtaactatgcaaaagctgctgctcttgccctattaagaacggaaaataatctttctgctaaagaaatcgtggcagaagcgttaaaaattgctggggatattgatatttacagcaaccataatcacgtgattgaagaagtatagtagggacacactgcgtgtgtccaaaaataaatatattgatgtaaattagcggacacactgcatgtatccaaaaataaatatattgatgtgaattaacggacacacacagtgtgtccctacaaaatggaataaaactatgtcaatgacccctcgtgaaattgtgtctgaattagacgcacatattatcggacaaaatgaagctaaacgagcagtagctattgccttgcgtaaccgctggcgccgtatgcagttgccagaagaactgcgtcaagaagtgaccccgaaaaatattctgatgatcggtccaacaggcgtgggtaaaaccgagatcgctcgccgtttggcaaaacttgccaatgcaccgtttattaaagttgaagccacgaaatttaccgaagtcggctatgtgggtaaagaggtggactcgattattcgtgatcttgctaatgtttcaatgaaattggttcgccaacaagcggtcgaaaaaaaccgtatgcgtgtgcaagatgcagcggaagatcgcattttagatgtgttattaccgccagcgaaagatcagtggggaaacgtgcaagagagcgataacacttctactcgccaaatcttccgcaaaaaattgcgtgaaggtctgcttgacgatagagagattgaaattgatgtcgcagcccaagtgagcgttgaaatcatgactccaccgggtatggaagagatgacttctcaactgcaatctctctttgagggaatgtcgccaaacaaaacgaaaaaacgcaaaatgaaaattaaagatgcgttaaaagtgatggtggacgaagaagcggcgaagctggttaatcctgaagagttgaaacagcaagcgattgaagcggttgaacaacacggtatcgtctttattgatgagattgataaaatctgtaaaaaaggtgaacacagtggcggtgatgtaagccgtgaaggcgtgcaacgtgatttactgccgattatcgaaggttctacggtcaatactaaacacggtatggtcaaaaccgatcacattctctttatctgttctggtgccttccaagtggctcgtccgtctgatttactgccagaattacaaggtcgtttaccaattcgtgtagagcttaaatcactaagcaaagaagatttcgagcgtattttaaccgagccgaatgcgtctttaaccttacaataccgtgagttaatgaaaaccgaaggcgtggatattgagtttaccaaagatggtatcagccgtatcgccgaatcggcattccgtgtgaacgaaaaaaccgaaaacatcggtgcaagacgtttgcacaccgtgttagaatgcctaatggacagtatttcattcgatgccagcgaacgttcaggcgagaaaatcgtaattgacgagaagtatgtgtctgatgcattgaatgatgtggttgagaatgaagatttaagtcggtttattctttaactatatacttacagtacaaatggaaattaaaattacaaaaatatgcattacaagcgttgaaactctctcaattttttacaaaattttgctacaatctatccactcacattccatttgcaaagagatgaataatgacaaacatcagcacttttaaccgttcttggtcacgcgttattttaaatgctttacttcgctacggcgtaaaacatatctgtattgccccaggttcacgctcaacgcctttaacccttgaagcattatatctgcaaaaacaaggtcaagcagaatgccatagccattttgatgagcgtggtttaggtttttttgcactaggacttgcaaaagcaacgcaagatcccgttgcaattattgtaacctctggaactgccgttgctaatctttaccctgcggtgatcgaggcgagtattactcaccataaacttatcgtgctttccgcagatcgcccccttgagttgatcggctgtggggcaaatcaagcgattgagcaacaacacatttttagtcattatccaattgcaagcctaaatttaccaaaaccaaattcgcaatatagtgcaagctggttagttggtcgtgtagagcaagcctgttctaaacaagtacaacaaggtggtgttatccatatcaatgcgccattcgcagaaccgctttatgaagctgacgaggagagcattgggcaagatccgtggttgctcgcaattcaaggttggctgaataaacctcaagtgaaatggtacgatcaacaagcgacccaacaagatgtgttgatgcacgaaaattgggattattggcgaaccaaacgtggtgtgattgtggtcggtaagttaccgcttgagcagggaatgggattaaaactgtgggctgaaacgcttggctggtgtttgatcagtgatgtgcaatctggggttgatgcctctctgccttatgcagatatttggctgtcaaacaaaacagtagagcaacgtttattacaggcggacattgttattcagtttggatcacagattgtgagcaagcgagttaatcaatttttatcggcttttaaaggcgaattctggctggttgaggaaacgacagattatcttaacacctatgctcatcaacaaacgcgttttgtggcaaaagctcaccactttacccgtgttcacccgccacttcgtcaaaaaccgtggctgttggaacctttggctctttctcaattctgtgaaacctttattgaacagcaagtgggtggcaatctcaatgaagcttctctagcacatcatatcgaacgtgtattgccagctaatggtaatttatttattggaaatagtttatttgtccgcttagttgatgctttgtgtaaattgccagaaggttatccgatctataccaatcgaggtgcaagcggtattgatggattaattgcaacccttgcaggtattgcaaaaggtagcggacagccgactgttgcagtgattggggatatttccgccttacacgatctgaactctgtttcgcttttacgtcagattagccaaccgaccattttatttgttattaataataatggcggtgcaatttttgatatgcttcctgtcgatcaaaaagcgaaagataaattctaccgtcttagccatagtcttgagttttcacagattgcgacaatgttcggcttagaatatctccgtccttatacttgggcggatttgggcacaaaacttaaacaagcctatgctcgtcgaggtgttactattgtggaaatcaaggtgaatgatcaggaaggtagtagcctttataaatccttgattgaacagatctctcgtgcttctatcgactaatgttagcaacaacgtggcacagtcattcaggaacccccgtggtctttctccacggatttcttggttctcaacaagattggcaacctgtcctctcgctcttgcaaaatacgattgcaatccaaccgcttactcttgatcttgctggtcacggtcaaagccaagctatctcgtgccacagttttcaacaagctagagaacagcttcacttcaccttgcaacaacatcttgctgaacagactttctatcttgtcggctattcattaggcggtagactagctttagattacgccctcacaacccaaaatccttatcttaaagggatcctgctcgaaggggcaaatatcggcttaatcagcgatgaagacaaaaaagcacgttggcaaaatgattgccattgggcagatcgcctaagtaatgaaccgcttggaaatgttttagaagattggtatcgacagcctgtttttgccaatttaagcgaaagcaagcggacagatttcatcaaaaaaaggctaaataatcacgggcaagcactagctcaaatgctcaaagccactagccttgcaacgcaaccctatttttcccctgaacaacgtcgtcagtttcacggaaaaatgctatttattataggagagaaagatagtaaatttcgtcaaatggcagaacaacatcagctcccctatcatcaaattgcaaatgcaggacataacacccattgtgaaaacccaagtgcatttgtcaaacatcttattcagtttatatcaaagtaggaattacaatggctttacatcgttgccccgaatgccgtaaaaaaatcagtgaaagtgccgttacttgcccacattgtggcttctcgttcaatgaagctgatttggaaatttataaacaaaagctagaacaacgccatttacataatcaagagataaaccgcaaaagcgtcaaacttcacttgatttggttagctatttttgtgttggttattgggctggcaagtttattatctgtataaatgaatgatgatgtaagtataaaaaaggatagtagataaaactgttgtcccaagaatattggcatagtagacaaaatagttgctgattcgtcaaaaactatgccaagtggacaaaataaccctatcccaaattctgtgtaaacacccatttcaacttaacggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacaaatcacgctattaagcgattccacggcattcgtggtataaatcgctttacgaatatcagccggataatcaaaaaatgtggcaatatttgcccagttatcttcccagcctttcgccacaagcgggtattttgcctgccatttttgcgaaagtgcggtcagattttcgcgagcctgtgcttccgtaggggcttgataaacctgctttaaatctgcggtgacggctttgtaatcgttccacgaaacgaatttcaagctgttacgcactaaatgcacaatgcaaagctgaaactacgatacaatctaggtaaacaattggataaaccgcatcaagtgggcgattttgccatgccattacgtgctctttcacggcgtcggtaacgcgagaaatcaggctggttgatacatccgcatcatagagttctttgaacatttcaacgatttcctgattacttaaccccttggcatataaggcaataatctgctcatccattcctgtgatgtgggtttggtttttcttgataagttgcggttcaaaggtgccgtcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctcatttattgaaatttaattatatttccattcattgatgatagttttatactttcaataacctctattgattctattgccgtttttatatttgatacaggttgttttcctgtttcaataccttcaattagacttaaaatggcatctatcattctttcatttggagtagtattgtgttttgaatagactaaatctaaatgttcatacttgctacctgatgaattttcactacttgaaaatttatataaatcataagatgatccattgttgtataatcttattcgcccattttcgccaagtatgtctaattcaaacatatatttcattggggaagaactagtacctttaatgaacccaatagaattagacttaaactttatcattcctgttcctccgacatcagaaataccgtgaacatttctcacaaaatctttttgaatatctccaacaacatattcaatatctgaaccagaaaaataaagcaataaatctattaaatggcttgtactcgtatgtaaagcagttgcaccataaccaactaaagaataaatattccctatagcatttgaatctaatagtcccttgatttcttgaataagattatcccaacgaaaaatgtaattaacagcgataataacattatgcttatcgcataactcaactatttccttagattcttctagagaataagaaatagtcttttcacagaaaatcactttaactccattcttaatacactctttgatgatatcaaaatgtgtttgaataggtgtacatatactgacaatatcaaatttattagatttcagcatttctttataatctgtatatccatttggtatatcacattctttttggatagaatctaccaaagatttcttaacatcacatactgatgatattcgtatattttcaatacttttatatgctttaatatgactccatatgatttttctgtttggatctttatctataccataagcaatcaagcctaatcctataacacccacattatacatattaatctccatgggattttttcctcaatgaaataacacatcctacaataacgattgcagcaccaaaaccttgataaatagaaatagtttcacctaaagtaaagtaaccaataaacgcagtagataagggaactgttaattgaataatattgaaaacaactaccccttgtttttgaacaatataaaatgcaaataacatacctgttagcattccatacattccagcaaagattaatccgatcagcaagcctgaactaatatcttgtaattgataaataacacctgtattacttgctaaaagtagataaacaagtccagataaagtagcagtggatgcactgataacgatggcatttaatttttttgcgacctttttaacgaaaaggttttgaatagattgaataaatatagctgtccccaaaaagagtgaccctgttataaaatcattacccccaccagttttgttgctataaattacaaatatcaaagaaccaattacagataagacgctaccaatataaaagctcttttgttttactttttccctttcatcttgaaagaaaattgcggccataataacagctaaaggcatagacataatgccaaaaatactgcctgctaaagctgaagtatatttaagaccattaataaaaaaatacatattaccagtcataaaaatagctaacaaaagaagatataagatgattgaaggttctctgagcaacttaagtagttctgttctatattttaatatacaaataaaaacgaataacaacccaccagagagaaatcgaacagcattattatttaaagtatcaaaatgaatactcatataacgcataataggaaaaccaaaacccattaacaaaacataagaaaatcttataaaagaatcattacccatacgactaagccccatacctaaaaggtaagtaagattaggtaattataaaatatttgtattgtttctcatagaaaaagagcatagattttgacatctatgcccttttcctataatctgtttcgtgcgttctttgctaagataacactaagataacagaccctagacaagtcatatcttagcaaagggtagctagtaatgcgaccctatcccaaattctgtgtaaacacccatttcaacttaacggtgatcgtctaggcgatcatcaaaatcaatcataaatcgattcatcgccggtttccggttctgaatcggcattgtccatttttttgatgcatctttaatcgcaagccaaatcactttgaacactgaatcatccgtcgggaatacatttcgttttttaatcacgcgacgaatcacgctattaagcgattccaccgcattcgtggtataaatcgctttacgaatatcagtcggataatcaaaaaatgtggcaatatttgcccagttatcttcccagcctttcgccacaagcgggtattttgtctgccatttttgtgaaagtgcggtcagattttcgcgagcctgtgcttccgtagggggctgataaacctgctttaaatctgcggtgacggctttgtaatctttccacgaaacgaatttcaagctgttacgcactaaatgcacaatgcaaagctgaaactacgatacaatctaggtaaacaattggataaaccgcatcaagtgggcgattttgccatgccattacgtgctctttcacggcgtcggtaacgcgagaaatcaggctggttgatacatccgcatcatagagttctttgaacatttcaacgatttcctgattacttaaccccttggcatataaggcaataatctgctcatccattcctgtgatgtgggtttggtttttcttgataagttgcagttcaaaggtgccgtcacggtcacgaggcgtctcaatttctatctcaccttcatcacaaatgacggtcttagatgtgtaaccgttacgtgcatttttaccttttctaggctgatgtttttaggtttttggcaaattccgctgccaaggcgtgaagttgtttttcgttcataattaaaatacctgtgtctgaatgtattatctcagaaacaggtatttacacaaattgtgggagaggctcacttctgtgacgatagcttaatttattgtaagacataatacaattttaataccctataaatgtacaattgctgcattctatcatttttattttactttgacattatcttataaacttataaaatactgttcgttctcattggggtgctttgtgtaacaaggctgagaaatacccatagaacctgatctgactaatatcagcgtagggatttgagacagacaatttatcttcgcctgttttagatccttctatttttacttttagaaggaatattcaatgaaattcaaatttttcactctctctgctttaaccctaactactgccacagtatatgccgaacaacctacattgaccgtgtatacctatgattcttttgcttcaaaatgggggcctgctgctgaacttgagccgctatttgaaaaacaatgccaatgtaatttgaaatttatgccttttgaagatggggtgacaatgttcaatcgcattcgcttggaaaagaataaaactaaagccgatgtaatgttaggcattgatcatttcttaatgcctgaagctgaaaaatcgaatttatttgtagaacataatctgcaaaataatgccaataacttaccgcttgaatggcaaagcaaaatatttttgccttatgattttggtgaatatgcttttatctacaacaaagaaaaagtcagtaatccaccaaaaagtttaaaagaacttgtggagcgtcaagatcttaaagtgatttatcaagatcctagaaccagcactgttggacgaggattgctcttttgggtaaatcaagtttatggcaagcaggcagaatcagcgtggcagaatttagccaaacataccgtcactgtgggtaaaggctggtctgaaacttatggtgcatttttgaaaaacgaagcagatttggttctcagttacacgacttctccgttatatcatcaatggcacgaacagacagataaatacgttgctgcagattttgcagaaggacatttagtgcaggtggaagtagcggcaatcacaaagagcagcagacaactcaaattagctcagcagtttttaggcttcttacaacagccagaatcgcaacgaattatttcttactataatgtaatgaagcctgttgtgaatactaaggcagatcctttatttaacaccttgccaacttatcaaactataagtttcactcttcctgataacagtgagataaagcgctggataaatacttggttaaatattgttaaccaatagtttttagaatggctaaataagctcaaaggtcacaatgacctaccccaactcctgcggatcaatatccaccgtcaatcgaatatcgtttcgcaggaactgttctttttgctcatcaaaacgatctaacaactgttggatcgcacttcttgccgaatgttgaataagtaactgccagcgataatgccctgctttttttgccatcggagcgttgaaaggtccgagtagctgaaagccttgccagccattttcaccgataatttgttgtaaacaagcggtcaaattttgcagaaaatttgcaactttgtcgctatctctacccgttgcacgaataagcacttgcgaagaaaacggcggtaagctcattatttttcgcatcgctaaggcttggcttgcaaaggcaaggtagccgtcgttgagtaagctggtcagtaacgggtgatcagggtaatgtgtttgtagcaccacttccccttgcttttccgcccgtcctgctcgccctgacacttgtacataaagctgtgccaaacgttcttctgcacggtaatcagtggaaaataggctactatccacattcacgattgccactaaagtaacattcgggaaatggtgtcctttggctaacatctgcgtgccgatcaaaatttggcttttgcctgcttggatttcggcaaggtgttgttccaacgagcctttacgagcggtgctgtcacgatcaatgcgagtaatactgtactgcggaaaacgctgtgccagcacttgttccagctgttctgtgccgatcccagtggtaatcaaattgactgagccacaatgtccgcactggcgtggaatggctttttgcgaagcacagtgatggcaacgcaatactcgctgtttttggtgataggtaaagggcttatcacaggacgggcaatcggcaatccagccacattcgtgacaaagcaaaacaggggcaaaaccccgtcggttcaaaaacaacatcacttgattgcctttttccaagtgagcttgcatcattgctaacaacttttccgataagcccgaataaatccgctgttttttcaaatcaattaaggtttgtttggaaaagtgtgcattaccagcccttgcagtaagctgaagttcgataaatttaccgttttgtacattttgcaaactttcaaaactaggcgttgccgagccgagaatgatcggaatgttgttatttttcgctcgaagcaccgccagatctcgtgcgtgataacgccagccgtcttgttgtttgaatgagccatcgtgttcttcatcaataatgattaagccaagttgctgaaattgtgtgaacaaggcggaacgtgtgccgatcacaatcgcactttcgccgttttttgctcgaagccacgcattgagccgttgagtgtcgttaagatgcgaatgcaatgcgtcaatttccacgttaaaacgagcttggaaacgttgaatagtttgtggggtcagcccgatttcaggcacaagcaccaacacttgctcgccccgtttcagcacttcttcgatcacttgcagatagacttccgttttccctgagccagtgaccccattgagcaaaaacgctccgaagccttgttgataatgcaaacggctgacgacaagggtctgctgtttattcaaagttaaacggttttgagtgttgcaaatcggctgttcgcctaatttttcctgccagctttgcacattaaaaggaagctcaaccttttccagataccctttttcaagcaaggctttccataccgcagggctacaagcggtcagcttttcaaagaaatttgcaaattccgccagttcgcttaatagctcttgttgttttttcgctttttgaaccacaccgttggctagggcttttctgccgttttccgtgacaacaaaatagtcgggggcagtgcgttcgctactttccccttgtcgtagtttgacaggcaaagcactttgtagcacttcgccgaaaggggcgtgataataacggcttgcccactgtaaaagttgccacatttcagcgtcaaacagagcttgttcatctaacagttgctcaatcggtttcagtttttcggtgggaatatctgatgtggtcgggaagtccaccacaatcccgattttacgttggcgaccaaaaggcacaacgaccctagcccctttcaccacattttcaaaatgcgttggaagcaggtaatcaaaataacgtgccaacggcacgggtagcgcaatttggatgaggttcatcagggcttcactttgcgaaaactatcaacacttaataagataatagataccgccaaacacgccattaaaatataggattttgcttctaatacttcaccaatggcaaaggaaataaataacattaccaaaggttcggcatagccaagtaatcctaacacattaatcggcagtaaattacttgaagcgatatataaaataaatgccattccattcactagccctaataatgctagataaaaatagagatattcattttgcattaaaatagaggcttgatcaacttgagcaatataataaatagcaaagggtaataacaataataattctacaaagaaagtagctaaattattaatatgaaaatagcgacgtaatacaatataaatagggtagccaaagccagcaacaaaagttgcccacgaaatacttgcggttaaaacaatattgattgtaacgccaagagttgcaaaaaataaagcaagccattttaataaagtaaaatgctctttaaaaactagtttacctaaagcaactgcaacgataggtaataatagataaccgatagaaacttcaatagcttgattattattcggtgcccaaagaaataaccaaagctgaatagctgtatttaatgctaagagcagaagaataaaaataagataaggtgtctgttttactctataatataaatctttaaaggctttttgttgatgaaataaaaagatcaccagtaaaataaatggcattaataccacaatacgaaagccaaaaatactatcgctttctaaagggcgaagtaaaaccgcaaaataatagccagcaccgaataagatatttgcagaaagtgaaaataagatcccttttaacattattccccccgacgctgtttacgaatagcaataatgccatcaagcactaatagacatatcgacagcatcaaacacaccattaaaatataggaagattgatctaacacttcgccaataataaaggcaacaattagcattgcaagcggttcaatatagcttaataatcccaaaacattaatcggcacaaggctacttgccattatatagccaattaatgccgtaccactgacaatgcctaataacactaaccaaaaataaaaattcggattattttcggtgacaaattgcatatcggtattgagcataaaataagtggctatcggcaacattaatataatttcgcagacaaagctggataaatgcgacatatcaaaatgtttacgcaaactgaaataaacagggtagccgattaataccattgaggtagcccaagagagtgagcctgcggtcattaacgtaatgaatactccaacagatgcggaaataattgagataatttttaagagagataaggtttcattaaataaaaatcgcccaacggcaaccattgcaatcggcattaacagataaccaatagacacatcaatggcataaccgttgtttggggcatacagaaaaagccacatctgcgagcctgtgaccgcagtagttgttaataataccaaaattaaatgggggtgctgttttaggcgttttaaatagcggttaaattcgtcgttttttttgaaaataaagagtgcagaaatcacaaaaggcaggcttacccacattctaaaaccgtaaatttcttcaccggaaagcggttttaaatgggtggataaataatagagtacaccgaataaaatagatgcggtgacggaaaatgtgatgccttttatcattgtgaaattgaattttgggttgttcaactcaaatatcatttagacatttcccttcccccgtttacgggggaaggggccgaaggcggaaggggggaataaaccttgctattaatcccccctcagccttcggcagctccccccgcaagcagggggagcgaaaataaattaatcctgacgataactctgcaaaaacttcgctaatcgtccaatcgcttcttccagctgatcaacatacggcaatgtcaccacacggaagtggtctggtttatgccagttaaagcctgagccttgaaccagcaacactttttcctgttgaagcagatcgtaaacaaatttttgatcgtctttgataccgtacatttccgtatcaattttcgggaacatatacatcgccccttttggtttcacacagctaatccctgggattttggtgagcaattcgtgagccttattacgttgttccaataaacgaccacccggtaagataaattcgttaatgctttgataaccgcctaacgctgtttgaatagcgtgttgcatcggggtgttggcacataaacgcattgacgcaagcatatctaagccttcaataaagccttttgcctgatttttcgggccgtttaacaccatccaaccttgacggaaacctgccacacggtatgcctttgacaaaccattataagtcaccgttaaaagatcaggggcaagaggggcaagatgatgatgtaccgcaccgtcatagacaattttctcgtaaatttcatctgagaaaataatcaagttatgttcacgggcaatcgccacaatatccaataataactgacggctatacactgctcccgttgggttattcgggttaatcaccaaaattgctttggttcttggggtgattttcgatttaatatcttcaatatctgggaaccactcattttcttcatcgcaaagataatgaaccgctttaccgcctgcaagggttgccgccgctgtccaaagtggataatctggcatcggaattaaaatctcatcgccatcatttaacaaggcttgcattgacattgtgatgagttcagatacgccgttaccaatgtaaacatcaccgacatctaaatcacgcataccttttaattgataatattgcacaatcgccttacgagcagagtacaaacccttagagtcgcaatagccttgagcggttggtaagttacgaataacatcaactaaaatttccgcaggggcttcaaaaccgaatggggctgggttaccaatgtttaattttaaaatcttatgcccttcttcttccagacgggtcgcttccttatgtataggcccacgaatatcgtagcggacgtgagctaatttatcggtttttgcaaagcgttccattgtttctccctaaaatagagggttaattatctgttaatttataaaaatctctctactgtactccgatttgttaggaaaaaaaagtggaaataggctaaaatagacttctattttgtcaagcggtgagatttttaggattttttgcaatgtctgtgtttagtcagttaaagcaacaactttatcaacaactacaacaaaagcctgtggcacaaggcttagtacagttgcaagcagaaattgcaatagaccttgaaaatcaacaattactagcttggctaaaagcacaaccgcttttcccccactactactggcaaaatcgagatacagaacaaacgatagtggcagtcggtgcggtacaaacctttgagcatttagacgacgtagaacaatttagcaaacagtctgatttaatggtcgtcggcggaatagaatttgaaggacaatgccattttgtgttgccacgcttgctgttagtaaaaaatgagaagaacatcaccgcttggttaaatctagatggtcgccattttgaaagcgaacaaaaggaatgtatcgctttgttagctcagtttgagcagacagccgaacttcaccccattgaaaatagcttgttaagcacaaaagttgcctgtgatttttcacgttggcaacacaacattgaattagcgattgaacaaattcaacaacagcaaatgaataaagtggtgttagccaatgcgaccaccaaaacttttacacacctcatttccccctacgttctgctttttgccagccaacaaaaaaatctaggctgttatcatttcttatggtcggaaaaacaaggggaagcctttatcggctcaacacccgaacggctctatttacgccaacaacgtcaattttttaccgaagctctagctggcacagtggcagtgacggacgatcctgttcaaacggaacaaaatgccctatggctactcaacgatcaaaaaaatatctatgaaaattggctggtcgtggacgatatttgtagtcatctggctgattgtgcaacggatattcaagtcagcgatgcagagatcaagcggttacataacgtgcagcatttacgccgaaaaatccaaacgcaactgacagaacaggtcagcgacgcagattgccttgctcgtattcacccaaccgccgccgtcgcaggactgccacgccctaaggcaaagcagtttattcaacaacaggaatgttttgagcggggctggtatgcaggggcattaggctatttcacccccgaacaagccgagttttgcgtaatgttacgttcagcccttattcaagctaatcaaattaccttttatgcaggggcaggaattgtcgaaaaatctgatcctcaatcagaatggcaagaaattgaccgcaaagcacgagcaatggcagggttaatggagtaatttctttttcatattttacttctgcgccttagattttcttcacaatagtcataatgtggtagtcgaaattagaataaacagactaggatatatctgttgagcttaattagaagtcagcaataagaaaccattgggggtagcacataacaatcagtaggggtggtgggactctaccttttagtaagcaggtgctaattattcattatattacagaaacattctatttattttacaggtatatcacgtagttttttaatgaatacaatttaatattgcataggatttataatatggtaaagaaactttcatttttgacgttattaatgttgttcattccagctacagcgtggttaattgggtggcaatggaatttgcaaactaatcttggtgttaatgttttcgattgggcgttgtttattttaacggaaacgggttcaacgccttatgcgttaatcacttgcgtgctgtttatgttgtggctgatgtggcttgcgcgcactcgctattcgtggtttttagtaggctttatttgtgcaacgtcggtagttggaacacaggcaattaaagagggggcgaaagcggtctttaaagagcctcgtccttttgtgacacagatgtttcaggcggatactgaggcattttatgctttacctaaagctgaacaggaaacggcggtattgaaatttgtgcaacctgaaaatcagtttgtggttgaacatcaagcagatgagctgggctactctttcccgtcagggcatacgattttgggggtatcttggctattgatgtttgcagggttgctgtttggtattcgtggacaagcggtgatttttgctcaattttttgtgattttgtgggctggtttgatgttgatcagccgtttgcggttaggaatgcattatcctatcgatctgtttgtcagtactttgattgcgtgggttttccacttgatcatcttcttatgggtaatcccactcttagaaaaatggatattatttaaaaagcgagactaactatggtttattacggtttggatattggcggtacaaaaattgaattggctgcctttaatgagaaattagagaagttacacagcgagcgagtgccaaccccacaaacgagttatgaggattggttaagaacggtggaaaccttagtgcgtaatgccgatgcaaaatttggcgagcaaggcactgtggggcttggtgtaccaggttttgttaatcataaaactgggttagcggaaattgccaacattgcggtggttcacggcaataaaattattcaagatttggaagcgcgtttagggcgtgaagtgcgtgttgaaaacgatgcgaactgcttggctttatcggaagcgtgggacgaaagcaatctgcaatattcaacggtgttagggttgattattggtacaggttttggtggcggtattgtgttgaacggtaaagctcactcaggtcaaatcggtatggctggcgaggtggggcatattcagcttaactaccacgcgttgaaattgcttggttgggataaggcaccgatttataaatgtggctgtggtaatatggcttgtttggatagctatatctcaggacgtggttttgagatgctttataatgatttagtcggcgaaaaagttgatgcaaaaaacattattcagcgtttttacgataaagatgagaaaaccgttgagtttgttgagaaatacattgagttaatggcaatttcggtggcaaattatattacggtgcttgatccagatatgattgtgtttggtggtggtttgtctaactttgattatatttatgaagccttgccaaaagccttgccaaaatatttattgcgtaatgcggaagtgccagtgattaaaaaagcgctccacggcgactcaagcggtgttcgcggggcggcggcgttatttttgaaataagtaggtcgggcatttatgcccgacaattatttatagaatacagcaaagtcgagcataaatgcccgacctacttggaaaattaatatgcttcaaatcaccccaattccagccctttctgataattacatttggattttacaaaaagagcgccaagcgattattgtcgatccagcagagactcaagctgtattcgcttttcttgcaaaacatcagcttaatcctaccgctattttgcttacccataatcatcacgatcatactgatggcgtggctggtttagtggcacaatttcccgatatgcttatttatggctcagaagaagtcagtcagtttgccaatcagattgtttaccctgagcaacagtttgaactgttagggttaaaggtgcgagtgattgagagtgcagggcatacggctcaacatattagttatttgatcgagaatgaatatctgttttgcggtgatgcgttattttcaggtggttgcggacgagtgtttacaggggattaccaagctcagtttgatgccttacaacgttttaaagccttgcctgattttgtgcaagtctatgcaggccatgaatatacgcaaagtaatcttaaatttgctgaagtggtgatggcgacaaactgtgtattaatggaatatcaagagcgagcagatattttacgttcacaatataaacctacgctaccgagtacgattggtattgaaaaacagattaacccgtttatgcaagcggtgactttagatgagtttattagtctaagggaacaaaaggataatttttaaaggtagattccccaatcttctatcctatggtatagttgtagttattttgattataggcatacattgcctttaaactgatttatttttaatcataaagtggatatttctgtggatattgaacctcaattaatgcctcaacacgttgcaattattatggacggtaatgggcgttgggcaaaacaacaagggaaattacgcatatttgggcatcaaaatggtgtaaaagcggtacgttctgcgataaattttgcagctaaacatggcattaaggtactaacgctctacgcatttagtagcgaaaattggtcaagacctaaagccgaagtgtccgcattaatgacggtgtttatgaaagcgttagattacgaagtcaagaagttacataaaaataatattcgactcaagattattggtgataaatcagcccttagtgaaagtttgcaaaatcgtattgctcaatcggaagcattaactgcgaataatacaggtctaatgttaaatattgctgggaattatggtgggtattgggatattacccaagcaactaagcagattgcattacaagtaaaaaatggtgaactttccgttgatgagattacccctgattattttcaacgtcatttagtgactgaagatcagccacaggttgatttattaattcgtactagcggtgagcagcgaatcagtaattttttattatggcaaattgcttatgccgagttagtgtttagcccagttttatggcctgattttgatgaaaaggcatttacagatgccattattgcttatcaacaacgtgatcgccgttttggtggttgttaatctataaggaaaattcaatgcttaaagaacgcattctttcggcaatagtgatgattattttagcagtggttgcactgttttggctttcacccttagcttttacgattggcttatccgctattgttgtgttaggtatgtgggaatgggctcagtttgcgggttttaaacgtccgatagcacgtgctattgttgcttttgtggtgacctgtttattgatttttcctattatggcagaaacaagttatattcaagctacacgttttttgactgatgaaacgacacctttgctctttattggcggtttttggtggttggttgcatcagctttggttgttagctatccaaaatcagcagatgtttgggctaaatcagtggtggctaagtttatttttggtttttgcaccttaattccatttttgattgggactcttgctttacgtttctatcaatataatctcgatcaatatcaaggcacttatttattactctatgttttcttgctagtttggggggctgactctggggcttattttgcagggcgtgcattcggtaaacataaacttgcacctaaagtgtcaccaagtaaatcttgggaaggggcgattggtggtgtgataacttctgctgttattgcaacgattttcttaagtgtagtgcctgcaaatgtgtttgggcgtgagttaaatacttctgcatttgttgtactttcagttattacggtagcgatttcgattttaggcgacttgagcgaaagtatgtttaaacgccaagtaggcattaaagatagcagtaatttaattccaggtcacggcggtattttggatcgtattgatagtttaacggccgccgtgcctatttttgctatcggctttttctttttcctatagggtagcacaatgacttcaatgctcgccttttttattctgatctgcgtgttggtattcgtacacgaatacgggcatttttgggcagcgcgaaaatgtggcgtaaaggttctacgtttttctattggctttggaaaagtattatggcgtaagaaagataaacaagggactgaatttgcattttcacttattcctttaggtggctatgtgcaaatgcacaatggtgaagcagaacatcaattaccagattcgcaatctttacatacaaagtctgttttgcaacgtgcttttatcgttcttgcaggtccagtggcgaattttttatttgcgattttggcgtattgggcggtgtttaatgttggggttccaacggttaagccagtgatcggatctgtgattccagattctattgcagcttatgcaaagctggaaacagaattggaaattaaaacggtagataaccgttccgttcaagattgggaagatgttaccctagctttgttgggcaagattggagaagctgaagttgttattgaaggcaaccatattgatgaaaatatttctcgtcaatttacgctagatttgagaaattggaatgttgatggaaataaggaaaatccgttaactactttaggtattcgtcctaaaagtgcgacggttgaaccaattattaaaaatgtagtcgaaaattcggtttcggcaagatcagggattttagctggcgataaaattatttctgttaatcagcaaccttttgaatggcgatatttgttagagcaggtgcaaacaggtaatattattgatttgacgattgaacggaataaccagcaattagcttttcagttgcagcctgaatattcaaaggaagatgagcgttatttaataggcttagtgccaacgtatcaaccattagaatcaaagtatcgaagtgaattaaagtatgatattctttccgcctttggaaagagcttagaaaaagtcgtatcattaagttatacgattttacagtttattggaaatttaattacaggcgagctttctctaagtaatatgggcggcccaatttcaatggcaaaaggggctggggcaacggctgaaattggttttgtctattacttaggatttatggcattgataagtgttaaccttgcagtgatgaatctgttccctattttgcctttagatggtgggcaattagttttactcactggggaagcggttcgtagaaaacctgtacctgaggcattccaactgcgttttcagcagattgggggtatgtttgtcgtagggttaatgctatttgcattgtttaatgatttaatccacttttagtcaagtggttagatatttatattattttaccaacgaataggatcatttaaatgaaaaaactattactttcaacattattagttgcaaatggcgttgcttttgcttcaccttttgtgatcaaagatattcgtattgatggtatccaaacatctgtaagccaaacaatgatccctacattacctgtaaaagtaggacaactagcgactgataatgatattgcaaacgttattcgtcatttatttgtacaaaatcgttttcaaaatattagtgcaacccgtgaaggagatattttaattattaaagtggtagagaatccagtcatcaataatgttgatattgaaggtaattctgcaatccccaaggagccactggaacaaaatctaaaagcgaatctcatcactaaaggagaattatttaattctacaaagttagacgcatttaaatcagcactcattgagcattaccactctataggtcgttacaatgctaccattgatactgttataacaaactcagacaatggaggtgtaaatattaaattagatataaaagagggagatgttgcctatgtaaaagctattaattttgaaggaaatcaagcttttacatcaaaagtattaatgaaacaactggatattcaacctgatgtttcttggttcaatatttttcaaagtagtaaatttgaacaaatagcatacaatcaagatttagaaaatctacgtaatttctacatgaaccaaggatatgcaaaatttaatgttgaagctgaacaacccgtatttagtgatgataaaaaagaagtatctttaacatataaaatcaatgaaggaataccttatactgtaagtgaaatacgtattattggtaatactgcaaaattagacaacgagttaaatgaacagctcaaatattataaaacaggcgagctctttagcaaaaatgaactttcaaaaattgaagacaatattaaacaagtatttggaaataatggttttgcttccgctaaaatagagcttcatccaaccttcgatgatacaaataaaacaattcgtctcacatttgttgtggatgctgggcagcgtgtttatgtaagacagattcgttttgaaggaaatgatgtgactgcagattcaacgttacgtcgagaaatgcgtcagcaagaaggagcatggttgtcaacaagtctagctgctttggggaaggctcgtctagaaagaacggggttttacgatagtgtagaaatgagctatccaaatgtcccaaatactgcggatcaagttgatattgtatataaaataaaagaacgaaatacaggaagtattaatttcggtgttggttatggaacagaaagtggtttaagttatcaagctgggataaaacaggataatttcttaggtatgggctctacaattagtttaaatggtacccgtaatgactatggtacaagtatcaatttagggtatactgaaccatactttactaaggatggagtaagccttggtggaaatatcttctacgaggattatgataattcaaaaaataatagtgtcgcaagttataaacgacaaacctatggagtcaatagtactttaggattccctgtaaatgaatacaactcctatttccttggtctaggctacactcaagatctgattaagaatgctcgacgtgaatttaatcgtgaactttatgtacaatccatgaaattcccgattgataatgacttaaatgtctataaaaaaattaaagcaaatgacttcgatttttcttttggttggaactataatagtctaaatcgaggttttctcccaacagaagggactttgacaagcattagtggacgtattaccacaccaggttcagacaataagtattataaagttagtattgattttaaaaactatttaccagtcaatcgcgaacataagtgggttatctcaactaaagcgaatattgcttatgcaaatggttttagtggtaaagaattaccattctatcaaacttatactgcaggaggtatcggctctctgagaggttttgcttatggagctattggaccaaaagcaatctatctgggtgaagatgacaatggtaatatccgattcaattccgtaaatagagatattgttggcggtaatgcaatggcatctgcaactttagaattaattactccaacaccatttgtaagtgaaaaatatcaacataatgtaagaacttcattatttgtggacgctgcaacagtgttgaatacaaaatggaaaactaatccagtagtaaacgacattcaatataattattctagtttagaaaactttaaagattataaacgttttcgtgcatctacaggtatcgcattccaatggaattccccgataggtccattagtattttcttatgcgaaaccaattaaaaaatatcaaggtgatgaaattgaacaattccaatttagcattggtggttcattctaatcttataaacaagcggatagatttgttcatttttttacgagtctatctttcctaacttcagaaaggacattttaatgaaaaatttatttaaacttgccgcagttgcttcagctttagcttttagtgcgaatacagtaaatgcaaatgaaaaaattggatttgttgatcctaatttcttaatacaaaatcatccacttaccattgaagcaaatgataaattcactaaatttatgaaagacactgaatctaaatttgcaccaagggaaaaacaattagcagcagaaaataaagcattatccgatgaagaaaaagcattattggatgagcgtaaaaaaattgaagaagatgcacagaagttacaaaaagaacaagtgaccttagaagctgcaatgaagaaaaaggtagcccaacttgaaaaagatgcacctaggttaaaagcgaaagagattcaagcacgtcagaataaaattaacgcagaagctaaaccattccaaaataaagtttctgcattgcaacaacgtgaagtagaatttggaaaaaaagcagaagagttccaaaaacgtgctgatgagtttcaaaagaaagtagcggctttccaagaagaaattgctaaggtacaaaaagaatctggtgtaataactcctgaacaagtacaacaaaaagtcgttgaagatattaatgcgaaaattaaacaagtcgcggaatctaaaggctatactttagttcttcctccatcggtcgcattatatgctaaagatggaaatgcagcagatattacagaagaaattctagttgcaatgggtggaaaaatgccagaggctccaaaaactgaagtgcctgcagcggaagtcacaaaaccagaagaagtgaaaaaataatggctgaattccgtttaattgaattagcggagcagatcggcggtactctaaagggtaacgccgatttggctattttaagcattgctcctttagataaagcaacctctaatcagatcacctttatctctaatgcaaaatatcgtccacagttagctcaatgccaagcgggagctattattgtttctgaagctgatgtcgaattttgtgccgaaggtcaaaacttgatcgtggttggaaacccttatgttgcttatgcgattttagctcaatatatggatacaaccccaacccctgccgaaaatatcgctgaaagtgccgtgatctcacctgatgctaaattgggtcataacgtttctgtcggtgcaaatgctgtgattgaaagtggtgttgaaatcggtgatgatgcggtgattggtgctggctgttttgttggaaaaaacagtaaaattggtgcaagaacaaaattatgggcaaatgtgtcggtttaccataatgtacaaattggctcagattgtttaattcaatcttctgccgttattggtagtgacggttttggctatgcaaatgagaaaggtcaatggattaaaattcctcagactggtggcgtgattatcggtaatcgtgttgaaattggggcttgtacctgtattgatcgtggtgctttagatccaacggtgattgaagacaatgtgattattgataacctatgtcaaattgcacataacgtacatatcggttatggcacggcaattgctggcggggtcgtaatggcgggtagcctgaaagtaggacgcttctgccaaattggtggggcaagtgtaatcaatgggcatatggaaatttgtgatggggcaatcattactggaatgggaatggtaatgcgaccaatcacagagaaaggaatttactcatcgggtattcctttgcaaactaataaagaatggcgtaaaacagctgctcttgtaatgaatattgatgaaatgaataaacgtttgaaagcattggaaaaacgtttagctgaataattgattgaggtcttagtagtgacaaccaaattacaaacagaaaatcgtgaaccaagaattattgaagtaactgaaattatggaaatgcttccacatcgttacccgtttttattagtggatcgtgtggtagattttaaagaaggtaaatggctccgagctgtaaaaaatgtgagtgtaaatgagccttgttttactgggcattttccaaatcaacccgttttcccaggtgtacttattttagaagcaatggctcaggcaacaggtgtgttagcgattaaaagttacggtaaattgaaagaaaacgaactttactattttgcagcagtagataatgctcgctttaaacgccctgtagtaccaggcgatcaaatgatcattgaagtgacctttgttaaagagcgtcgaggtattacggcatttacaggtaaagtttatgtagatgatacgctagtttgcgaagcagacttaatgtgtgcgcgtaaataatcttgcttgaataaagaggaaaatactatgcaattaattgacgcttcagccaaaattcacccaacagccttgatcgaagaaggtgctaaaattggtgcaaatgtggaaatcggtgcattttgtgttatcggcaaggatgttcgcattggggctggtacaaaaattcactctcacgttgttattcaaggtgatacagaaataggtgaagataatcaaattttccaatttgcaagtattggtgaaattaaccaagatcttaaatatcaaggtgaaccaactaaaaccattattggacatcgtaaccgtatccgtgaaagtgtgactattcatcgtggcacggttcaaggcggtggcgttacgcgtgtgggtaacgataacttatttatgattaactgccatatcgctcacgattgctctatcggtaatcgttgtattattgcgaataatggtactttagccggacacgttacccttgatgattttgtgattgttggaggaatgtcagctattcatcaatttgtcgttgtgggatcgcacgttatgttaggtggtggttcaatggtgagccaagacgttccgccttatgtaatggctcaaggcaaccacgcccaaccgttcggtgttaatcttgagggattaaagcgtcgtggctttgagaaagcaacaatgcacgcaatccgtaatgtgtataagttaatttaccgcagtggtaaaaccttagaagaagctattccagaaattgaacagtatgccaaaacagaggcagcggtcagtttattcttggatttctttaaacgttctacgcgtggcattattcgttaatttgttcatgctctcttattgaggaattaaaatattcgagcatacattctgtatcaatggcaaaaatgtatccatataagatgttgttctaaagaatatagatacatcgatttttaatctgacatattaataagtagttattctataaaaacctgttgacaaacgctctattttagaggattctctcattcactttttacgcttaatatttagagaatagcgatgaaccgtttttctatgattattaccacgatgatgaccattatgtgccaacatagtgcgggtgttcgtggctagaaaacggaacaagattcacagaaacccgcttaaacaagcgggtttttttgtaacaaaatttgcaaacattaactattatcttcaggagaaattatgcgagttctaaaatttggaggtacttctttagccaatccagaacgctttttacaagccgccgacatcatcgaaaaggcacatttggcagaccaagccgctggcgtactatccgccccagcgaaaatcactaaccatcttgtcgctattgtcgataaagcccaaacaggcgaatcctacgaatctcatctcaccgaagccaccgacattttcaataacatcatcaacggattatatgccgtcaataacaatttcgaccgtgaaggattaagtgcctttatcaaagcagaactagacgacatctgcaatattgcagctgaagcagcaaaaaataaattctgcccagataatatcggtgcaacagtgcatagccgtggggaaaaattgtcgattgcgatgatgaaagcgtggtttgaagcgaaaggttatgaagttactcgcattgatcctatcgaaaaattattagcacacgggagctatttagaatcttctgtggatattgctgaatcgaccaaacgtattgaagctctttctattccaaagaaaaacgtcgtgttaatggcgggctttacggcaggtaacgaacaaggtgaattggtgttacttggtcgtaatggttcagactactctgctgcctgtttagccgcttgcttaaaagcgaatgtgtgcgaaatttggacggatgtggatggtgtttatacttgcgatcctcgtttagtaccagatgcgatctgtttagagtctatgagctatcaagaagcgatggagctttcttacttcggtgcgaaagtgatccaccctcgcactattggtccgttagtaccgttaaacattccatgcttaattaaaaatacccataatccggaagcaccaggcacaatcattgacagtaatgtagtcaatgataatttaaaagtgaaagggatcacgaaccttgataatgtggcaatgttcaatgtttcaggctcaggtatgcaaggtatggttggtatggctgctcgtgtgtttacttcgatgtcgcaagcgggtatttccgtgaacttaattacacaatcttcttctgaatatagtattagtttctgtgtgcctgtaaaagcggtcgaaaaagcactctgtgcgttaaacaatacttttgctcaagagttaaaagatggctcgcttgatcctgtggaagtgatcaaagatctctcaattatttctgtggttggtgacggtatgcgtaccgccaaagggattgcggctcgcttcttctctgcactggctcaagcaaatatcagcattgtggcgattgcacaaggttcatcagaacgttccatttctgcggttgtgccgttaaataaagcgattgaagcggttaaagctacacataaagcgttattcaataacaaaaaagtggtcgatgtctttttagtgggtgttggcggtgtgggtggcgaattgatcgaacagatcacaacccagaaggaatatcttgcaaagaaggatattgagatccgtgtttgtgcattagctaactcaaataaaatgttgctcaacgaaaacggcttaagccttgataactggcgtgcggatttagagtcggcgacacagccatctgactttgatgtgttgctttcattcattaaattacatcacgttgttaatcctgtttttgtcgattgtacgacagcacaatcggtggcaaatctttattctcgtgcattaaaagaaggcttccacgtgattacaccaaataagaaagcgaatacctcaagctatgcttattatcaggaaatgcgtgaaaatgctcgtcaaagccaacataaattcttatatgaaaccaatgtgggcgcaggcttgcctgtaatcgaaaacctacaaaatttgcttgctgccggcgatgaagtcgagaaatttgaagggattttatccggttcactctctttcattttcggtaagttagaagaaggggctacactttccgaagcaacgaacattgccaaaggaaaaggctttactgaacctgatccgcgtgatgatttatcaggacaagatgtagcgcgtaaattactgattttagcgcgtgaatgtggctatccgttagagctggaagatattgaggtggaaggcgtcttaccaaaaggtttctctgaaggcaaaactgcagcagaatttttagcgatgttgccggagcttgatgcggaatttgcaaaacgtgtggaaaacgcgaccgcttgtggcaatgtgttgcgttatgtgggctccattgaaaacggtaaatgccgtgtcgcaatcaaagaagtaaacggtgatgatccgctttataaagtgaaaaacggtgaaaatgcccttgcgttctatacacgctactacagcccgattccgctattactgcgtggctatggtgcaggtaatgatgttaccgctgcaggtatttttgcggatattttgcgtacgttgaaatagggctttttgatgttttgaggttaaaaaaccatcaagaggtgtttatttaacatcccagcacggcagagccgtactgggttacgcataattcagcccctttggggctgagaattagagtggcaaagccactcaactatgcgtaacctagtacgcattttgcgttctaggtataaaacagcatattttataagcacaaaacatcaacaaaccttaacagattatcaatacttttgtaggggcgggctttatgcccgcccgttgatatatagacacgatttcgggtggggataacccccctacgaaaatctatgtatgtctaatcccatataaaataaggaaaaaaatgacattacgaatttatgccccggcttctagtgcaaatttaagtgttggctttgactcgcttggcacagccatttcgccgattgatggttcactgcttggtgatgtggtacaaattgaagagtgcgatcaactctttgagttagaaagtgtcggctattttgtgcgtaaactgccgaaagaaccgcaaaaaaatatcgtttatcaagcctatgtgctgtttagcgaacgtttgaaattgcgtggtggcgtagtgaaaaatttacgcctcacccttgagaaaaatatgccgattggctcaggcttaggctcaagtgcttgctcaattgtggctgcactcgtggctctgaatcaatttcacgatgaaccgttttcaaaaatggaattgttggaaatgatgggcgaattggaaggcagaatttcaggctcaatccactatgacaacgttgccccgtgctatttaggcggtctgcaattaatgacacaatcgctcggtaatatttgccaaccgattccgttctttgatgaatggtattgggtgttggcttatccagggattgaagtgtccaccgctgaagctcgtgcgagtttgccaaaaagctatactcgccaagagatgatctcacaggctcgctatttaggctctttcgttcacgcttgccacactcgtcaagacggacttgccgctattatgatgaaagatctgattgctgaaccgtatcgtgaatcattactgccaaactttgccgaagttcgccaaggttgtaaagatttgggagcattggcggtggggatttcgggttcaggcccaacgatgttcgccattgctccagacttagagcacgctcaaaaattggtcgcttatcttgaaaaagattatctgcaaaacaatgagggttttatccatatttgtaaggtggataatttaggagcgagagagttgaagtaagctcagcatacataattattctcatagactccgcccttattaagggcggaaaagcaagagaaaatataatatgtcttagtaaagtaaattcctatcccctcaaatcactcgcctgttgcaatagattacggctctctttaaggaattgttcggaataatcgccaaaccaacaatgcactttttcaaaggcatcaataaagctctgcttgtcgttttgctgaaagaatgccaagctcttttcaaagctctgttgtagcgaggcaatgacatctaaattttcaggcttatcggcgataatttccgcatacaacttcgcatcttgggcaaatagacgacctatcatcgctagctctaaacgataaatcggagacgaaagtgcaagtaattgcggtaatttgaccgcttgttgcgataaatgtaacccataagcaaaggtagaaaagtggcgtagcgcttgaatgtaggtcattgcatgatcgtgttctttggcatcgatctcttcaatcttcgccccccaaatccgcatttggtcaagcagccattgataacgttcagcaaaacgtccgtgacaacaagcgatcacttgtttcgcaaaacttgcaatatctggcccaaacattgggtgaagcccaacaacggctccagaatgcacttctaacatcttcgctaacggctgtgctttgactgaggtgagatcagctaagatcatctgttcgtgcaaatacggctgtaaacgctcaagggtatctaaagtgttggcaatcggcacacaaactaccactaaatctactccgtgcataatctgttcggcttgctcccagtcatctcgatcaaggcgttccaccgaatagcccgataattcaaaataacgagcaaacagtccgcctaacttgccccgaccgccaacgaccacgatttttcgcacttgctcatttgtcgctttaaagccgtgtttattctcgttggcataggactctcgcattagacgacgcaatacatcttcaatcaaatccgcaggaacaccctgactttccgcttcttgacggcgagcggcgatcattgaggcttcacgttcaggggcataaatcggcaaaccatgctgatgcttaattttgccaacttctgccaccagtgaaagacgttttgacaataattcaattaactgttgatcgacttgatctatctgttcacggataggatttaatgggttcatactactttcttagggtttctgcaaaatcggttaatagggtttccgttgtctgccaatcaatgcaagcatctgtaatagatacgccatattgcatctgttcaaaaggttgctcggacgattgattgccggcaaacaagtggctttcaatcatcaagccgataatagattggttgcctgcaaccagctgttgtagcacattttccgccaccaatggctgacggcggtaatctttattagagttaccgtggctacaatcaatcataatcgcttcaggcaagcccgctttgcgtaacgcttgttcacactcttgcacatattgtgcttcaaaattcggggattttccaccgcgtaaaataacgtgtccatcaggattgcctttggtgtgcagtaccgtcacttgcccctgttggttaatcccaataaagctatgccccattgcagaagcctgcattgcattaatcgcgacgcctaaatttccgtctgtgccatttttaaatcccactaccattgataaacctgatgccatttctctgtgggtttgagattccgtcgttcttgctccaatcgcagaccaactgaatagatcagcaagatattgtggactaatcgggtctaaggcttcggttgcaagcggcaagccaagttccgctaaatctaacaataatttacgtgcaatgcgtaaccctttttcaacatcgaatgtgccgtttaaattagggtcattgattaaacccttccaaccgacagtggtgcgtggtttttcaaagtatactcgcattacaatgtaaagtttatctgacactttatctgctaatacttttaattttctggcatactctaatgcagatacaggatcgtgaatggaacaaggcccgataacaataagctggcgtttatcacgtttatggataatatctgagattacctttcttgatttttcaatctgtttacgcagatgttctggcagtggaaactcttgctttaatccttttggggttagtaaaactttttcatcacaaatgtttacgttgtgtaagctatcctgattaaacacaatgttcatttttatttcctataattgtaaaaaaatcaatacagaactaatttacaacgtaattggtaaagtttcaatgtttttttgacttttagaggggatttgtagggacacgctgtgcgtgtccgtaaaataaatgaataatggacacacgcagtgtgtccctacattcgtcctaaaatacatcattccccctatttatgagaaatccctgagtaatacgaggattgtgctggatgtagggataaaccccataatattttgggcggacacattggtccgcccaaacaatgattttataaataatcttgaattttctgtttcacctgctctactgaaattcgctccatcagcccatcaccttttgcacttgtcgcccaaggcaactgatcccaaggtttcccacgactttctaataccgcctgatcataaacagatactaccttatctaaatctaaataagggcctgtacggcgtgggttatgaatcgcatatagaccaatcaccgttgtattttgagttgtcgcaatatgagctggccccgaatccgaagatagcaccaaatccgcttgacgaattaatgccgcaagttgttttaaattggtttttcctgcaagattaaggcaattcggtgcaagttgttgaatttttgcagccacttccatctcataaaccgacggagatcctgcaataatcacattgatgttttgtgctaatgcaaactgtgcaatttgcccataattttcaggcaaccaatctttctcttttttgctagaacaaggggcaatgactaaattttttcgttgtttatcaataaattgagacgtataggctaaatccgcttcactcacaggcaagtcccaagttggacgtagatcttgcacaccaatcgctttagcaaacatcatctgaccgtctaaaacgtgaggggaagcggtcttttccacctttttatttgtaaataaccactgcccttctcttgcacgatctcgattaaagccgaccttttgttttgctcgaatacctaaggataaaatagaggcacgcaatgccgtttgcatatttaacagataatcgaaccgcttaccacgcagctgtttccataacgcaaaaatccctttccaccctgtttttttatcataaggcacaagggttacattcggaatgccttgcattaacatcgactccgttttaccaatgatccaagtgatttccgctcgcggatattggcgttgaatggcttgcacaaccgcaagggtatggcaaacatcaccaatggcagaaagtcgtaaaatacagattgattgcgggctattcatctttcttcctataaacatttcgcaggttttggcaagcctgcaattttggttgcctgttttgctgggccttcagggaataaacgttgcaaataacggctactgcccttttcttcaccaaatttctgcgataaggcttttactagcattcggattgctggggaggttttatattcttgataaaattctcgcacaaaatagacgatttcccaatgggcttcgctaagttcaaggttatctttttgagcgataactacggcaagttcaggcgaccagtcgtctaaatttttcaaatagccgtgttcgtctgtggggtattgttgatgattgagttcgataaaatgaagcatacaagatgagggtgtaggatgaaaactctaaaagaagagcccagcattctaaaaagaacttaattaaaatgctgggctataaatatattacttgtcaaatcaatctgataaatcgcaaagcctgtttcatcagtgccaacgaatgacattggatattgtgctttttctgcaataaaggcttttgctttatcgcttggcgaagtttcaaagcgtacatctaatttgcctttagcggcaattggagcaatacgccagtttttgtctgcagctggactgacttgaccgttggctttactttcagcagtaatataattcgctaaaatttgacggttttcatctggtccagcaaagacaatatgactttcacctgtgccagggaatttattgctatatgcacggtagttgttggtcgcaattaagaattctgcttttggatcaactggtttaccgttataggttaaattcattacacggtgagctttattgttgattaacttacattcgccatcataacgtgctggttgagtaatatcatattgatattgaacgccgtcaatcacgtcaaagttataagtgcggaaaccttcccagtctaatagactttgtggctgttcgttcgctggatcaatttgtttaaacataccagcactgcactctaaccactcttttaactcttcgcctgtgactttaaccacaacaagggtatttggatagagatataagtcagctgcgttacggaatgtcaattcacctttgtttacctcggtataaccattcggatcatttttacgaccgccagctttaaacggtgcacccgcacttaaaattggtaaccctgctaactgcggcaatcctctcacgatattttctacataggctttttgtgcttggttcacaatttgtactgttgggtcatcttgaactaaagcaaggtagctgtacatattgtctgtcgctttaccgattggttgtgacacgaatttacgagttgcttcgtgaacaggttgcaataaagcggcaacttcagggtgattttctaccgttgcagcttttttctcattatcatagattgggcatagcacggctttaccatcaaccacaagccatttgcctttttgttttgcaagagttaagtccacaacactgatattgttcgcccagtaacctgccattgactctggaatacctttcactgttcctttttcaatatccacatttggcgattttacaaactctttatttgggaataggcggtgtgagtgtccaaaaatcaccgcatcaatgccttttacatcagcaagatagaatgctgagttttcagcgccttctttataaggctcatcagatggacctgtatgagcaagtgctacgattaaatccgcccctgcttttttcaggattggcacatatttttcagcaattttcacaatatcacgagcttccactttgccgtctaaatgggctttatcccacaccattacttgtggtggaacgaaaccgatataaccgacatttaaagtatgtttcacaccatcttcatcaaccacttcttttttctgaatgaagtatggttggtaaactggctcatctgtacctggtttaacgatattcgcattgatgatcgggaattttgcttctttgattgcgtcatcaaggtattttaaaccgtagttaaattcgtggttacctaatgtccctacatcatatttcattaggtttaatgcatcaatcgcagggttagatttcccttctttataaccgaccgctgcttgatagtccgcaatcggattaccttgaattaagtcaccattatcaacaagaacgctgtttttagcctctttgcgagcttgttcaattaacgttgccgcacgagtaaaaccaaattttgttgttggtgcatctttgtagtagtcaaaatccgttaagaaactgtgaatatccgttgtgccaataacacgcaaagaaactttgctatcgcctgcagcaaatgcaaagcggtttgcactaattgctaatacggtggtcgcaccaatttgaagaaaacgtcttctgttcatcataacaagtatcctcattgatacaaaaaaggagagtattataggcaataatactctaaaatgccttaatccttttatcaaatctgtgatcgacttcacagaatagataaattaaggctgtataaaaaccgctattctaatttctgaagcggttactttagagggaatatagaacagataaaaactagattatctatgtaattagaaataaataatacatataaatctacttaagatccctatacctcataaaaatccctgcatgataagcagggatcttattagattaaacttttaataggttactcttttgacttccaaattaacggatcaacaccacggcgaataagctctgggtgatcttcaattttgaatacaggctgctctacacctgctttcacttgtttttggtaatcttttaagataacccaaacaattggagcaagtaaaacgatagacactaagttgatcatcgccattgatgccattacggtatcggcaaacgcccacacaataccgccatcacgcacagcaccgaagtaaacgaaaaataacacgattaaacggaaggctaatacgaaacttggtttgttacggatatagcgaatattgctttctgcataagcatagttaccgataattgaagtgtagcagaataacaataagataaaggctaagaagtgtaagccaaattcaccgatgtggaactctaacgctttttgggttaaagatacgccacgcaatgattcgctaccataatcgttagacattaaaataatgattgcggtacaagtacatacaataatggtatccacaaatacccctaacatttgaattaagccttgacttgcagggtgttttgcatctgacgttgccgctgagtttggtgcagaacccatacccgcttcgtttgagaataaaccacgtttaatccccattaacatcgcttgtgagaataatgaaccaaagataccgccagccattgcagaaaagtcaaaggcacttgtaataattttatttaaaacttcaggtactcgctcaatattcatccctaaaatgatcattgccataattaagtagaataacgccatcatcggcacaactttcgctgaaacctgaccgatacgtttaaccccaccgaagataatcgctgcagtcacaatcactaacacaatgcccacataatgcggatcccattcccacgcattacgcgttgcttcaacgatagagtttgcttgaaccgcattgaacgcaaaaccgaaggtaaaaattaaggtaattgcaaaggcaatcgcaagccaaggagcttttaaaccacgcttaatgtaataagctgggccaccacggaacataccgtttggatcacgcactttataaacctgtgccaatgatgattctgcaaatgcactactcataccgattaacgcagtgatccacatccagaacactgcacctggtccgcctaatgcgatagcagtcgcaactccaccgatattacccacgcccacacggcttgccaagcctgttgcaaaggcttggaacggggttaatgactcgccctctgcagcacggccagaccacatttcacggatactacgaggtaataaacgtaattgaactaagccagtggtaatggtaaagaataaaccgacacctaaaagggttaatacagtaatgtcccaaagtggaccgtcaatcgtgttcacgatccattttaaaacatcttcaaaaattgaaactatgctatccatcgaaaagacctcataaaaagtaaaacgatttcggcattttaacgattttttatcttttttgaaaagattttttaattaaaataataaaaaaagttaatgattggttatttaacgggctgggctggtttaaataacaaattctgtctaattagcaaataatatagtagggacacgctgagcgtgtccatcaatacgaattgagttttttgttagaatggacacacgcagtgtgtccctacaaatacttttatgaacggtaataattcaacgtcattgtagggacaccacgcttggtgtccattgaatatgacataacttaacgcttaaacaaaagattttggcttgtatctaacaaactactgtggaataaggtaaaaccaaaaccgatcaaaagtaatccaatcagcaattttccgaataaaacagaccgcttgtgagccgaaaatgaaagataccaaccgctaatatgcactgctttacggcgagcaaatagaaccaaacaggcaaacagcgttagcgttagccccgttcccgttgccattaataaagccgaagccacgccccaaaggtataaatccaaagtataggctaaaaacagcactaaaattgcccctgaacaggggcgtaagccaatgctaaaaatcaacatcagcgtgcttttccaatccgttgccgttgctatttcggacgaacttggcaaatgtttatgaccacaactacaatctgcagaatgttgatgatgagcagtaataagcggtgattttggggctattttttgcaaatggcgaatttgaaagccctttggcttcgctctcacgctttttaacgcttgataacaccaatacagcccaaacaacatcattacaacaaaactgcctcgctcaacccattttaacgctagattaaaatagctacgagaaagggtaaaaatcaccacaataatcgtcactaatccaatcgccaccaagccttgcactaatgcagataataaagtgattttcaccgcttgtggcagtttggtttgttcaaaagagagataacttgttagaataaatttgccgtgacctggaccaacggcgtgaaacactccatagataaagctcactgccattagagtcagccctgcctgttgctggttttcattcagacgatttaacgcctctgaaagcgcaacattaaattccctctgccactcgctgactttaaataagagatagggataagcctgataaatcgcaaaaagtgccaccaatccgaccgctatcccagcccaatactttgcctttattgacatacaatactcactttttgcgcaaattgtgcgcctaaagacaagccacgttctgctggcatatcgggggtttcatttttatctaatgtcgatgcatacaaccgcaaagattgatttaccgtcggctcaatcatctcaactttacaaagattttgctctgtgctactgacatcactcgctttttcgtaattcattgctaagtaataacttggctcaaaggtaaaaaaacggaatgactgcccttttaccgctttaggctcggctagtagcaaggtgaaatggtaaataatacgattatgctgaatttcaacggacgagttatgcggtttagctttaaacttaatcggttcattttgctgattataaagctcgctaaaatagtgggtactcaccgcagattcatctaactcacgcaaaattttattcattgcctgttttttatccttactgctgttgatttcatagatcagttcagctgatgtaatctcatcaagtgtccagtacaattcaaaaccttccagcttaccttgttgaattagcactttatttttcatatcaaggaaagagtgtggatgagcaaaaacagaaaaagagagtaacagcgaaatcgtgccgataagaaaacgcttaagcatttgaaatccttataatgaaatcaattttaaaatcattatatcagacttttataagggctttttgttccgacatgcttcaataaaaaagcgaacagacaaaatctgttcgctcttaaaaattaggctgagtcggtcgataagccgagttctgtcgtggacaatcattcctctaggcgtacattcacacatacgctcaagcaacctacccgaatcccaagcgggcaactcgttggattcctatttggtcttgctacgagtggagtttaccgtgccgtgaaatgttaccactcacgcggtgcgctcttaccgcaccctttcacccttaccagccgaaactggcggtctgctctctgttgcactagtcgtaggctcacgcctcccagacgttatctggcactctgccctgtgtagctcggactttcctctcgtttacttgtcccactaggtcgttcttacgaacggttaagggcttcaataaaccagcgattgtctaaccaactcagactggcgagtatagcggatttatgaacttttgcaacaaaatgaattgtctcattcctattatcaacgcagggcaagatcgcatctttctcaaatttatgatctaatacaccttaattatccatatcaaatcaggttgtaaaatgagcgtttttcgtttttttgaaaatttatccgacccacgagcctataatcaaaaacaccactttttagacatcgtttttctcgtcgtcagtgccgtgatttcgggggcaaatagttggactgaaatcaaactttttggcgaattacatttggattggttgcgaaaatatcgtccttttgagtgtggcattcctgtcgatgatactatcgctcgtgtaataaaacgcattaaatgcttgagacgtttgaggaggtaaatgcggaacgtcgtcgaattgatgagcgttactaccgtaagctgaaagtgagtgattggctgagcaaagcggaggaatggaaggggataaaatcggtgttggaggtgtgtcgcaagcggtcagataatggcaaagaatcgcaagaaaaagtcttttatatcagtagtttggatgttgatattcaaatattgacgaagtgcgtgctaaggcattgggaagtggaaaacaaagcccattgggtgctagatgtggtctataaagaagacgaatgtgctgtgaccgatgaatggggtgcggaaaatctggcaatcttgcgtcgattagcgttgaacttggcacgattacacccgaaaaagcagagtataaaagggaaattgaccgctgccggttggtcagatgaatttcgagatgagctgttgctcggcgtgtaggttgaaaaatggacaacatatgcggttgccctgcttcagccgtaatatcgtttaagctcttacttgctttattattaatcaaggtagtcagtgctgtattcacagagctaatcgctgttgctacaccaccaacggtcgctaatttatcggtatcgccgttcgttgcagttaacccattgttagcaaaagtccccgtctgaagatcaaacttcactttgccaccattttctgtgctaatggttaactggtctgtatcttggctgacaaactgcaatccagtagagagagccgttgatttagcggtttcactccctgctttataatttagctgaactttctcctcaatcttatcaatcaagtcctgatttttggtgttatcatccaaaacatctttcaccgcatctgctacattcgccttactgactttaaccgtataagtcttcacatcatttgccgtagccgatgtcacagacgcaatattatccgcatccgcagaatgtttaacctctgttgcagcttgaatcacagatttacctgcactatcaagattgctcaaatccttactcgccgaattagcaacgccagataactctttaattttcgccgcatctaaactcagggtgtatttcttacccgtagtaccgtccgtacgatctgttggctggcttaccgtaatccctgaatttgcttgagcctcaaccaattccacggaagaagtcgttgaggtaattcctaatttttgtttccaagcattgatatgagtttgattggttaaattgcttgcatccaatttcgcaaaagtatctcccaccgctgtttgtacatcggctttcatcacagagacttcataggttttgacttgcgttgaattattgacagaactagtcacttgcgcaatgttatttacgtcatttttacgagtgacgttagtgagatcggtaatagccgttttgccctaaagcagtctcagccacagcgccttcacccaatgcaacaccgccctcttgggtcacagaagcctcactcccaatcgcaatacccttaacactggttgcacgagcctttgttcccaaagcaatgctatcctctttcgttgcttgcatgttttcattcgcattatagttattagagttagcggttgaatccattgtcgcaccaatcgctatggcacgtttacctgtagtcagcaccgacttaccaataccaatggcagcctcgccagcaacggaagcggcagtacctacggaaatagaatagactccaatggcataggcttgacgcattatcgcaagggagttttccccatttgccaaagccgctggaccaagtgcaatagctgaaatcatagatttagaattagccccaatggcaacacttagagctccctcagcatctgctttagatcccaatgcggtactacctgatccattagcctctgggcccatcccgtaagcaactccccctacctatttagagtaaaccttcttccctctaactacctcatcaagtcctggattgccttcggtaatataactgagtatatcagtattagctgcctgagaaatctgccctaatccattagcactatcagcccaagccatatttgaaacaaacaaacctgaaataacagtagcactagctccccaccattgcggatgtgaacgattgatctcaacgccagaacgctcgccatttgatgatttaacctttccttttgccaattctgaaactgcaacccaagtttgcgaggtgtgattccaaatcacacgaaaaattttattcataatgtatccttattcagaaacagataacgactattttttactccataaaaaacagccgttattaataatatttgcatgactgacgctgataacaaaaagctaatgcattcaattctttatttgcttcaaaaattctagaaaaattcctgtattgtgcagggattgacccatcatataaccacaacctattgattttattggggtgaaaacccagcctataatatccaacctatttaatatgcgttttatcgacaataaaatcctcgccattataaaatattatttattcgcccataataagcagtgaggatatataacaattcttttaactcatgaaaaaaaatacaaaactgacaaaaaataacaaaagcatcataacacctgattattctctcaatttattgcctctgtttgctatcattggatactctcacatatcgatacactcctattacactaaaattgatatcctaaggttgctaaaatatttcttgttttttgacttgacgtaagcacactctctaatgccagctgagcaaaaaagccattgttaaaattcactcgtgaactaaaacctaaggtaaaaagagatggggttagtctataggtttgtgtaaagtggctgtttgctatctcgctaaatttggcgttgttacgataatttctaccgcttaatctatgttgatagatggcataggaatcgaactgaatttgggcattatctaatgtggttgcatagtttaataaaagcccagcccccagagctgttgagtgataattcacgctgtcgtatgattttgtaaaaatccgaccgctttcattaaatgcattttgatgtacaaaatcatagttgaaataggccagtggcgatagcgtaaagttctctcgtttataggatttggcaacgcctagctgtgcactcgcaaagcggttttgataagagcctgtgatgttctccctttctcccacaatctgtttctcatagtggttttgcgacttgcctaaatttacgccactcaatagcttgaaatggtcaaaatgcgatacataattcagtgcgacattgaaagtgtctgaatgagagttcgcagaatggaaagtgcctttgcccctttcataatttaggctcattgcaagctgttgtttattatcaatgtttgtcgccacacccatacgcaatccgtgtgaattagctttaaattcattcgcttggatgatgtgatagcttggtgtcaggtaaaacgcatattttttctgtgccaaattatgtttgactaatttagacaagaacatatcttcgccagccactaatttttttattccgttggtattgaaacgctgaacaaaatagtttggggttaagctaaacagtagattttgttgagcaaagtgggtggttttgatagtgctgtcgttgagcatatcaggcaaatgatcttcagcaatgctgtttaatacggcttgtctattggcggtattatccagtttcacaaagaaatctcgatatgcttggctgagatctgcagatgttcttgcggtataaatcgcttcaccaatgtcactatttggaatataaaaagcctctttcttaaccttgacttcagcgataagtgtaccgtcttgagcaggtattgcttcaactttttccttctctttttctacgttgttcggctgttccgttgacacggtttcagaagtgctttcctctgttacgttatcattaggcttaacttccgtgcttggttgctccgttgaagctgtttcagaagtgctttcttcttttacggtatcactcagtttagcttccgcatttggttgttcgattgatacagtttcaggactactttcttctttaacagtatcattcggcttaacttccgtatttggttgctccgttgaagctgcttcagaagagctttcttctttggcggtatcgctaggctgaggttcagtaacaggcttttcttcaatcgtatcatcattaatcaccgtgcgatttgaagcgagtttaaaatccgctattttaaattccgttgagccattacttagaatttccacgctctcaaaacgattaaggctatttgctaatgagcctaaatcaatttgcactttctgccctgcggcataaaactgaccgcttaaaggacgataaagtaattttccgcctttaatgtcgtaattttgtgcaactagctttgaatttccttgagtgttgaaatttaacaccagtttagctgtgccgtgatgagtatagttttttccgaccgttaatgtcgcaatatcatcactgccagcaataacagtgcctttattgtctaaattgttggcaatcgtaccgcttccgcttagggtcccgtcttgttccacaaatactgaactttcgctaagtgctgagccattttttagacgtagctctccgccacgcaccaaagttgcccctttatagctgttgctaccacggaaagaaagttgccctaacccttgtttgataaatccaacattcaatcctcgcatttgttctgcaggggaattttttgctgtggcaagatgtaggctgtcgtcccacattttttgctcgatattgttagcaaattcgccattttgtccttgagtatcaatcacataataggcttcggttttccctgttgggctttgaatatcacttacatttagacggtttgcgtcaagtgtcgctacgccgtttaaggctttttgtacatcaagtatgccctgccccattaaatcttcgcgttttaggctataaatattgttgcttcctaagattttattgatcgtaataccgtctttatcgggcttatcactgtaccccagtccagctatatcttgtctgatttgagtttcgtcttgtggtatatcctgatcaatataaatgatactaaatagttcatagccaggtttctgtttgataatcaccttaggcaaagtgtaattttgatttgcggtagataacagcacatcggcgatctgtttgccatttaaaaatgggaatttttgagcgacaagagctgctgcaccactaaccatcggcgctgcttggctcgtgccagttaaagggataaattcctcttgtttttctctatttaacttattatgcacatcaaaaagagcatttgccgcatcaattttactgccaggtgccattagggaataagcctgagagcctaaaaagccgttggaatatttgtggataccttgtaaagtcaaggttctttctccgcctgaatcaagctgatttactcgtttttctttgataataattttgccgtcagaatccacatcaataccatcagcatctaacattcccactgcaataaatgagcgaatatcttcatcataacgaggtaaaagttcaaacaaagacgcactatttttcccatcattgcctgaaccaaacacatttaatactttgcgttctttggcaagtctaacgatccgttctacttcatttttattgtagtaaccactagatctgtctttttccacctcttttaaggcttgttcataactagagatattttgttcataaggaaaaaccttatagccccaactatgattgacgatgtttaattttggatctttactgaaaaaatcaaatagatttaagccccaataattaaaatttgagctttctttaaacgcagctccataaaattttgcattaggggcaacaccataagggtctccatctccatcaaaagttgcttgtcgcccaagatgtttgcctaacaaaatccctgcaacgtgtgtgccgtgtcgaaatgtggcgttatctttttgtgctgaaccgatactacctgcatcatttttataaatatcatcaaaatttttataaccaccgatttcaatggcttttccctgcaaactagggtgttctggattgaataaagaatcaacaacaccaacgactacattactaccatcaatggtaggattttgcgctttggctttctgtaagtttatgatgttatatgatttttcaagggtaacaaaaagatcactggcaaaaaggctagggcttgataacacagcacagcattgcaaaggaaaaagaaactttttcatatgttgtctcctaaaaaatgaatattgttttatgtagggcacactgcgtgtactcgccccaacaaaaatcttaattcgtatcggcggatacctacattcactctgtttcgttatttataatgttgacaatcctactctcaactcacttgaaaacatagaaaagtctgtcaactggctaacacctattaatatttaacatattgtattcgtatattgcgtaatctttttcttgctaaatcaaatattggatgattattctaaaaatttagtcaaaaacaaacatgacgacattaagacgtaatgatacttatacatctatttgtctactgtggcaagttctgcatctcaatttcgtaacctcataaaaattgagatgcattgtatctatgttggaaattagaatggctgttattggttaatccgtcctttcaagaaatccaacaactgatctttggcaatcatctgtttctcacctgtacggcggtttttatactcaatttcgccattttcaagatttttttcaccgatgaccaccatatgtggcacaccgatcagttccatatcggcaaacatcacacctgggcgttctttacggtcgtcgaaaatcacatcaatgccttgtgaacgtaaggttttatacagatcttctgcaaaggtttggacactttcagacttgtgcatattcatagggacaaccgcaacagtgaacggtgcaatcgcatcggttggccaaatgatcccacgttcatcgtggtgctgttcaattgctgcagcaacgacacgagtaacaccgataccatagcaacccataatcatcgtttgcggacgaccatcttccccttgtactgtcgctttcatcgcttcagaatattttgtgccaagttggaaaatatgccctacttcgataccacgtttaattaatagggtacctttaccatctgggcttgggtcgccttctaccacattacgcaaatctgcaatttttggtaaagcaacatcacgttcccagttgatgttgaagtagtgtttaccgtcaatgttcgcccctgcaccaaagtcactcattaacgccacacttctatcgataattactggaatcggcatattcacagggcctaacgaaccgacacctgcaccgattttcgctttaatttccgcttcgtcagcaaattcaaacggctctgccacttcttcgcatttcacagctttgatttcattgagttcgtgatcgccacgaataactaatgccactaacggctgttcttcacttctacctttaacaatcaaggttttcaccgttttttcaattggtaggttgaactgctcaacgagctctgcaatggtttttgcatttggtgtatctacaagggtcatttctgccgttggatcttgacgctcgccgactgcaatcgcttctgcaagctcaatatttgccgcataatcggattcggttgagaacacgacatcatcttcaccgctttgtgccaatacctgaaattcgtgtgatgccgaaccgccaatagaccccgtatccgctgcaacaggacggaaatctaagcctaaacgagtgaaaatattgctataagtttggtgcatcacatcgtaggtttcttgaagcgactctttgctggtgtggaatgagtaagcgtctttcatcaaaaactcacgtccacgcattaccccaaaacgtgggcgcacttcgtcacggaatttggtttgaatttggtataggtttaacggaagttgtttatatgaactcacttcacgacgcactaaatccgtaatcacctcttcgtgggtcgggcctaatacaaacgggcgatcgccacgatctttaaaacgcagtaactcagggccataatcttcccaacgttcagactcaacccacaaatccgctggttgcaccacgggcatttccacttctaaagcaccgcttttattcatctcttcacgaataatattttccacttttttcaacacacgcaacccagtcggcaaccagttatacatacctgatgcaagcggtcggatcataccagcacgcaacattaactgatggctaacgacttgagcgtcgttcggggtttctttcaaggttgaaaagagatattgacttgtacgcatttatttatcctatttgtatcaattctataaaacgaaacgggaggtattttaaatcaaaaagcggtcagatcggcaaagaattttgcaaattgtaaaaaaatcctaaaatctgaccgcttgttttaggtaatttcagagaaatgccgactcgatcaaaaatccactatggataatccctgagcataatgttagaattacctaaatttttcgctaaccgatagcgaaacttagttctggtgttgtggaaaacaaaggctggttcgacttgtattaaaaggcttgaatttagcaaattttcctttacactattcaactctcgcacttagcaaatttatacacataggaaacaaaaaatgagcattgaagaacgcgtaaaaaaaattatcgttgatcaacttggtgcaaaagcagaagatgtaaaaccagaaacttctttcattgaagatttaggtgcagactctcttgacactgttgagttagtgatggctttagaagaagaattcgatatcgaaattccagatgaagaagcagaaaaaatcactactgttcaatctgcgattgattacgttcaaaacaagcaataatctccatttagaaaaagcgacttttaaaagtcgcttttttttctgcctcttatttttttctctaaatatatccgttcttaaattgcaaaactaaaccgttttagctactatgcacaaaattatttttagactttgaaaggttgatttatgagcaaaatttgggtattaggtgatgccgttgtcgatttaattccggatggcgacaatcattatttgcgttgtgctggcggtgcgccagcaaatgttgcagtcggtgtttctcgtttagggggtgaagctggatttatcgggcgtgtgggcaatgacccactgggtaagtttatgcaacaaaccttgcaagcagaaaaggtttcaaccgagcagatgatacttgatccacaacaacgtacttccacagtaatcgttggtttagatcaaggtgagcgtagttttacctttatggtcaatccgagtgcagatcagttcttagaggtcaatgatctgccaaatttccaacagggcgaatggttacactgctgttcgattgcgttaatcaatgatccttcacgttctactacgattgaagctattcgtcgtgttaaacaagcgggcggattagtgtcgtttgatccaaatttgcgtgaatcactttggtcaagccttgatgaaatgaaaaaagtggtgaatagtgtcgtggcaatggcggacgtgttgaaattctctgaagaagaattgaccttattgactaatacgacaaatcttgaagatgcaacgaaagaggttacttcactttatccagagaagctgattattatcactttaggtaaagatggggcgatttatcacttaaacggtaagagccaagttgttgccggtaaagccttaaaaccggtagataccactggggctggcgatgcctttgtgagcggtttgttagctggtttatcgcaagtgtcaaactggaaagagagtgatgcggtattagttgaagtgatccgcaaggcgaatgcgtctggtgctttagcaacaacggcaaaaggggctatgtctgctctgccaaataaagctgagttagaggcgtttttaaaataatagatttgattctcctattgtacaacccaaatataatttacctttactgggttgtacccccaaaaggtaggcgaagatatgatgaagagccattcttacaaacctttagcaaaggtctaatgcgccaataatgcaggggctttcttttggctcttcccccactacaacagcgatatatatttcaaaatccctttaattttttgtgaatcggcaatgtctaacacattatcctgtgataaagcgcccattcttgccgaactggtcgaatccattagactttgacgttgtcctttggctgaaaaatgaatttcaggcacttgggtttgttcaatgatttgtttaatgttatctgcattaatcccacagccagccattatttgaatacgcccattcgcttgtttgactaactgctgaataacaggaatcccatcaaaagcagtcgttgcttgccctgatgtcaaaatacaatgacaacctaagtcaatgagttgttcaagagcagtaatgggatctttacagagatcgaaggctcgatgaaaggtgatctccataccttgtgaagccttaactaatagttctgttgttgctaaatcaatctcaccatttgcagataacgccccaaaaacgaccgcttgtatgcctagctgcttggcggttgcaatatcgttgagcattatctgaatttcatcttcgctatacagaaaatcacccgcacgaggacggatcatcaaggctaggggaatagtcgaaatttgttgagcctgctgaataaaacctagattcggtgttaagccgccaaccgcaagggcagagcatagttcaatacggtcaatcggaaattgatttgcagtgatgaccgactctagattatcgacacagatctcaactttcatttattcccccacgataaagcgataatgaatatgatgttgataagactcgtttgctttgctgattccgccatagtgccaccattctgggtggtttggagtatcagggaaaaactcaggttctagggcgactcctgcataatcaggatagcttccgctcgtcaaattaggctgtccgcccagccagttccctgtataaacttgcaatgctggtttggaggtacgaagttcaaggcgaagattatcatacgctaaaacagcatcagcctgacaagcggtcagatcttggcaagattttgcaagtaaaaaggcgtggtcataacctttaacggcttgttgatcggtatcagccagtaaatcttgaccgatcatttttgctgtgcggaaatcaaaacttgtaccttcaacagcttttaatggggcattcggaatgccattagcaccgacaggaaggtatttctccgcactgagttgtaggctatgttgatgaatggtcggttcattagaaagattgaaataggcgtggttggtgaagcagagcggtgtatcttgagagcttgccgcattaaattcaatctcaagttgattaccgttcaaacgataaacgacagttgctgttacttcaccgccaaagccttcttcaccattggcgaaaattttgtaaaaagtgaccgcttgttcatctgccgattgcacctgccacacacatttatccgccccgatttccccaccgtgcaaattattttcgccattattttttgccaaaataaacttttgcccattaagctcaaaggtgccatttgcaatgcggttggcataacgccctaccgttgcaccgaaataggctgattgctcttgccaacgttcaggcgtggtggttactaatacttctcgttgttcatttgacaatttaactacgcaagaaagccaagatgcaccaaagttagatagggtgattttgagatgatcgttttcaagggtataaattttcatatttgctctctttatgttgcttcccctctcccgcaagcgggcgagagaaatgatattatgactgcataatttaaaccactcgcaccccatcacttgctgtgcaaacatagaaagtttcttgaatgccagtttgtttttcgtagttttctgcgatgagtttacgcaacgcttccactttttcatttggaactaagcagacaatacaaccgccaaagccaccgcctgtcattcttgcaccgccatttttgccgatagccacttgagctaattcaactagatagtcaatttctgggatagtgatttcaaaatcatcacgcattgagtcgtgagattcgcccattaatacccctaatttttgcatatcgttggctttcaaggcttcaactgcttctagcacacgatgattttcgctgataacgtgttttgcacgtttgtaagctaattcattaagctgttgtaactctgccgctcgttcaataaattgttcagggctaacatctcttaatgctttaacgccaaagaattgtgccgcaaattcacactcttgacggcgactattatattccccagtcactaaatcgtgtttgacgttagagttaatgatcgcaatggaataaccttgcggtacaggggttgggctaatttctaagctacgacaatcgatcattacaaggtgatctttttgtcctaatgccgaagtgagctgatccatattgccacaatttgcaccgacaaatttattctcagcacgttgtccgattaaggcgatctcggctagactaatcggtaaattgcctaacacttggcaggttttaccgatagaaatttcaagggcagcagacgagcttaatcctgacgacatcggtacatcactggtcattgcaatatccgccccttgaataaattcaggacaacgttcttgaatatatttcaccactccacgcacatagtttttccatttatcttcgctttgtggaatttcttttttaatatcaaaggcatcggtttcattaatatcaatcgcatagacacgccaaatggaatcgtcacgtttcgcaaaactcacagacataccatagttgatcgcacaaggcatcacaaagccatcgttataatcggtatgttcgccgataatgtttacacgacctggagcaaagacggtttgctgtgacgcataaccaaaatgttgttcaaattgagtttgagagagttggatcggggtcataaaagctccttcattttgttattatttcccctctcccgcttgcgggagagaaggatttatctttgtttataatgaacatcttcactcaccgctcttaatttttcagcggcttgctctggggttaaatcccgttgggcttcggctaacatttcatagccgaccataaattttcgtaccgttgcagagcgaagtaatggcggatagaaataggcgtgcagttgccaatgttcaatattttgcccatctttaaagaacggagcaaaatgccagcccattgaataagggaaagcacattcaaacagattatcataacggcaagtgagctttttaatcgcaagggctaaatcgtctttttccgcttcgctcaattcactcattcgtttgatatgacgtttcggcatcaaaatggtttcatatggccacgccgcccaatacggcacaactgcaagccaatattctgtttctgtcacggtgcgtgtgccatcttttagctctgcttgagcataatcgaccaataaatttgagccgtattgttcatagtaacgacgtaaatttttatccttggttgcaatttcattcggtaaaaacgagttcgcccaaatttgcccgtgtgggtgtggttgtgagcaacccatcatcgcccctttgttttcaaaggcttgaacccacagataatctttgcctagctcttctaattgagcattccaagtatcgactacaccacgaattttttccacaggcaattcagggagtgttttactgtgatcaggcgaaaagcaaatcaccctagccaaaccacgcaccccttgaattttaaacaacggattgtcagagggcggagcatcaggtgtatcttgcatcaaagcagcaaaatcgttggcaaacacataagtgccttgataatcagggtttacatcgcctgaaacacgggtattcgtcgggcagagaaagcacttttcatcataactcggtagctgttcaaccgccgctttatccacttggccactccacggacgtttcgctctatgtggagaaactaaaatccactcatctttcaaggggttataacggcggtgagggtgatcatttaactcaaatttttggctcatttggagtgtcctttcaaaaagttgaaataatatggagtatagcgtaaataatgcaaagaagatatgaactagatcacaaaatggaatcatccactcattcttgaaaagaaaaaagctaaacccatacgggtttagctctactactcaaataaggtctgcttagcaattacatcattccgcccattccacccataccgcccattccagcgcctaggtcagctttttcttcttttggtaggtctgtcaccatacattcagtcgtaatcattaaacctgcgatagaggctgcaaattgtaatgcagaacgagttactttggttggatctaagatacccatttctaacatatcgccgtattgttcggttgctgcattatagccgtagttgccattgccgtcttttacgttacgaaccacaacagaggcttcttcaccagcatttgttacgatttggcgaagtggtgcttccattgcacgaagtgctaaacgaatacctacgttttgttcttcgttatcacctttcactacatcagccactttgcttgctgcacgcactaatgccacgccaccgcctgcaacgataccttcttccacagccgcacgggttgcatgaagggcatcatccacacggtcttttttctctttcatttcaacttcagttgctgcaccgactttgattaccgcaacaccgccagctaatttagccacacgctcttggagtttctctttgtcatagtctgaggttgaatcttcgatttgttggcgaatttgtgccacacgccctttgatttgtgcttcatcgccgacaccgtcaatgatggtggtgttgtcttttgaaatcaccacacgttttgcttgacctaactcttcgatagtcgctttttcaagttccataccgatctcttcagagattaccgtacctgcggttaaaatcgcaatgtcttgtaacatcgctttacggcgatcaccaaagcctggcgctttaaccgcagccactttcacgataccacgcattgtgttcacaactaaggttgctaacgcttcgccttcgatatcttctgcgacaatcaataatggtttgcccgcttttgctactgcttctaatactggcagaatttcacggatatttgaaattttcttatccactaaaagaatgtatggattttctaattctactgtgccggcttctggtttattgatgaaatatggcgataagtaaccacggtcgaattgcataccttcaaccacatctaacgcatcttctaagccagtgccgtcttcaacagtgattacaccttctttacccactttttccattgcttgagcaattaatttacccacagtactgtctgagtttgcagaaatcgtaccaacttgttcaatctcttttgacgtttcacacggtttagaaagcgattttaactcttcaacaactgctgctaccgctttgtcgatacctcgttttaaatccatcgggttcatacctgctgcaaccgcttttaaaccttcgtttacgatagcttgagcaagtacagttgcagtagttgtaccgtcacctgctgcatcatttgctttagatgccacttctttaaccatttgcgcacccatattctcgaatttatcttctaattcgatttcacgagcaacagatacaccgtctttagtgatggttggtgcgccaaaggctttgtctaataccacgttacgacctttcgggcctaaagttacttttactgcatctgctaatacattcacgccctttaacatttttacacgagcgtcattaccaaattttacgtcttttgctgccattttttattccttgtagggacacactgcgtgtgtccgtgattaatttgtaaaaatattgaatgatttaaccgcttgttgtagttggacacacgcagtgtgtccctacacagttattcaacaattgccaaaatattgtcttcagaaagaattaatacggtttcaccgtcaattttttcttctttcacaccatattcattgaaaatcaccacatcaccgactttcacatttaatggtaacacagtgccattatctaaagtacggccattgccaacagcaatcacagtacctcgagtagatttagttgccgcagagccagttaaaacgataccacctgcagatttagtttcgatttcttcacgttttaaaattactttgtcgtgtaacggacgaattttcattgaataactcctcattattgtaattagaaataactatagtaatagaaagtaattattggatctctatctggagatttcaagggggaagagaaaaatttgttaatatagtctaggagatattgattgacgtactctccgctataaaaggcgagaattcctactagctcctattgttctcaataggctacttcgtattgctcattttaccaagtcaacgcccgattaaacacaaaacgagcagatccgcagaactgtttaattctgcggatttgctgcctgccgcggtaatgcgcccatttcgattattcgccaatacatcgagcaacaacaaacacctgcttagttaggtttgaaacggctcacaccgtttgcgccttatatctcgatccttcaggacggagtttgacggcacagtcccgataaattaataatagctctaagcccttttccacccttcacattgtatacattatccatcgaaatatagtaaccatgcaactccgcaatacgccttacaatcgacaagcctaaaccgctccctttttcattctgcccagcaggacggtaaaaacgctgccccagtttagcaagatctgcctcatcaacaccaccattatcttccacgataatacattgcgactctaatgtaatacgaatggtcgtaccttgagggcaatatttcattgcattatctaccagatttcgtaacatcaaggaaagaagtaacggctgaccttgtttaaccgcaggtacgcctttttgttcaaactcaatttccatctctcgtttttgagcttggaaataaagctctcccaccaatgatggaattaatttctcccaatgaatatcttctacaccttccaattccgttaagttatctaaacgggatagcgtaagcagttgctcaattaattgtgttgcacgattaattccttgagtaagattatacaaggctttctcgcgtaaagcggtatcatctccagctaattgtgcaatttccgtttgaattttcaatgcagctaacggactgcgtaactcgtgagcagcgtcagaggtaaagcgacgctctcttaataacacagttgatgttttatcaaaaaactgatttaagctagtaactactggtaaaatctctttcggcactgctgtcgaaagcggactgttatcgtcaggtgttcgctgttgaacttgctccccgacacgttgcaatgtcaataattcacgcttaataacccacacaatcaatcccaataataacggtaaactagcaaaccagatccacatttggctaaacaccattccttgaaccagatcatctcgataatcttgctcttgaccgaccgccacaaaaaaacgatcactaatcggtaaccaaaaaattcgccactcatcgtcatcttcgtgattaagtcgggatttggtaaaaccactggctcttttaaatggaaagtttgcaccattatgcccgtcacttaatatcctttccccttgagcattaaagatagcaaatgccagagcgtcatcatcgaaagtggtctttttaaaagatttcttatgatgttcgccgttaaaagcccgttgtggcttacgttccatcaataatgtgcgtaaatctgaagaagccaaacgttgagcaaataacacttgttgagcatcaaacacttcatcaacttcgtgacgaacttgcacccacgccactgcagtggatataagccaaataagcaacgctgtgcaagaaatgacgatcatcaagcgaaaacgtaaactggtatttttaagcaacttcatcgttttttcctaaggcatagccaacactgtgtacggtacgaataaactgttttccgagtttttggcgtaaattgtagatatggacttcaagggcgttgctactgacttcatcgtcccaagtatagagtttctcttcaataaaagaacgggtgagaacacgctctttattgtgcataaatagctcaagtaaattgtactctcgtgtggttagggtgacttcttgctcccgaagaaacactttgcgttggtttggatcgaatttaactaaactatgttcaatcacggggttggtatgcccataacgacggcggatcaaagcttgtaaacgagctacaacttctgcgagagcaaaaggtttacaaagataatcatctgcaccacgttgtagcccagtgatacgttcatcaagggtatctcttgcagtcaaaattagcactggcacatcttgatttgcccgtcgccaactttgtaacacctcaagtccgtccattttaggcaaggtgagatcgagaacaacggcatcataaggagcagaacttaacgcctctaagccagatctgccatcggcaaaccagtccacactaaagccagatttactcaaaccaagttttagcccttcaccgatcaacggatcgtcttcaactaataaaatacgcatctcaacctcccaatttcaaaaaagaaaagtggcatttacagccactttcccattatcgcattaatttgctttttcaacacgatgaacatcaacttctgtaccgaccaatgatttatcaatttcaccataaagtctgatttcatcatttggagtaacatttaaccctctccaagcctcgtcatcaatatcaacagtaatctcaccgcttgcatcacggaatgtgaaattgtctttatccaattgtttaaccaacttgccttgcaagacaacatattgatcatcgctcattgaagaaacttggcttgctggagtaatcgcttgctggctattattaaagccaccattttgataataacctttgtccgcaaacgctgaaaggctaactgttgataaaattaatgctgaaagtaaagtaagttttttcataaattgctccgagtgtttattagtgaaagcactattgctttgttgagtgtattaaaacagagaaatcttaagaaagtcttaagataagaaaatttatttttagacaaaatctaataaaaaagcggcaagattcgtaaatcctaccgcttagatcacattattaaaaaattagaatctatagtttgccccaataatgtactgacggccagggtttatatgtgaatgtaaacgttggctatgactttgatatcgtttatttccaatattattaatagcaaagtcgagacttaaatcatctttgagtaatctcagattagcataaatatcgtgtactccgtaaccagctttacgaattctttcatcgccacttctagtcgtaatcacaaaggttttagcttctgcataacgccctctatatcctatctctagatttggattctcaaatgtataggaaagggttgttttccattggcgacctttaggtacaatatccaaaacatcccccgaaagtttaaagccttcaggggtagctcttgaataacttgctccaacaccaatttttagccctgcaatttcataagatgcttcagcatcatatcctctagttctaagattgccaagatttgttatagtaggagcagtaactccggagtaataattcgttactttttcatcaaaaaggcttgctacaagtctagctcctgaatgtttccattcaaaaccgacttctgctagacgtgattgttcaggttttagattactatcaacatctctccttccacgaacttgtgctaaatttgcacggttatctgttatagtattagctgtggctaacgctggggaacggctggcataattcaattttgtcttcaatgccaagtttgaggtgatatcccaaattacattcaagctaggattcacttccccctcagaagcatgaactttagtactatttggtttgcctaatgtatttaagctgaaatggtcgtagcgaacgcctgttgttaaagtaactttctgaattgcccaaatagcttctaaatacaatccatactcttttttactttcacctttcaaacttcctctgcgttggttttggctttctacagattcattgcgtaaatttattccatatttaagcagatgttcactgaataatgggctagtaaaattaagattagctcccttagtatgtgtttgagaaactcgttctccctgtataaagtttgtatttctttgatcttgctcataagctaaacgttcatcttttaaatgaatatagaataggttggcatctagatctcgaataaatccaaggttcgttccagtataatttaaattatatgtacgttgagtatcctcaatcggaccaggagatacccaatgagcgaactccggacgttctgcactatcaccataatagtgctcttgacgaaaactaaatcctatatggtgattctcattaatatcataaccaactttagctaaatagtttgcttgttgacgagctgtattaattgcctcattagttttacttacaccatttatatagccttttccacctttataatttttattatcaacccagctacctgtcgccaatacatctaatccttgatgataaccatatacagaaagatttccacgaatacctttattactgttataagtcgtaccgactcttgcgccaaaagcatttccttcttttagtaaatcttttgcatccacagtctccgctcttattgcaccactcgtcttgccaattccagcactggctgaaccagcacctttatctacacgaatatttttcatcatgacgggatcaaactgaaagcgcccctggtggtaccaaagttgtgttcctgtttcggtattatccacaactaaattaacccgattttgacctgcgctacgaatagagagatattgcgcagaatcacttccaccaccaacaccaacttctgtcttattagcaaaaagttctcttaaattttgtattttggcatcatccgcaatgattgtatttttttcttttacttcaacagtatccaaaaccagtgtattggcataagctgccccgcttgtaatggctaaagtaattaagctcatacgaaaagctatatttgacattaaaactcctattaggtaaaaaccaagtaaaacactcagaaataatcataaataaaaattgttatcacttcaaataaaatttaatagaatactgagaaaataatagaaataaaaaaacccagctttcgctgggttcttaatataagtaagcaaattatttgattttggcttctttataaacaacgtgtttacgcacaactggatcaaattttttgatttccattttttctggcatattacgtttgttttttgttgttgtgtagaagtgaccagtttcagcagtagaaactaatttgatcttctcgcgattacctttagctgccatttgttagctccttagattttttcgccacgagcacggatttcagctaatactgcatcgatgccttttttatcaataatacgcatacctttcgctgttaagcgtaaagttacgaaacggttttcgctctcaacccagaaacggtgagtgtgaaggtttggaagaaaacgacgtttagtcgcattcattgcgtgcgagcggttgttaccaactgctggacgcttgcctgttacttgacagactctagacattttcaattctccgatattacttaagcttaagctaaatggttcgggcattcagaaaggctcaactcaatctgacgacctcgtcaggtacatacacccgacccacagactattttaaagactgtgaattatacttgctttagctcatctaaacaaggggaaaattcgtaattttcctgttcaaacttctcttcttcgaacgaaaaatagtcacctttgccaacaataatatgatcaacaaagcgaatatcgactaaatcgcacgccatttcgatttttcgagttagaaagcgatcagcctcacttggattacaattgccagatgggtggttatgagcaactaaaatggcagcagcattacactttaaggcctctttgatgatttcacgaggatgaacagatgcttggttgatcgtgccataaaacattttttctgttttaattagcctattttggttatctaaaaagatcaccataaacacctctcgctcccaagattctaattccgattgaaaatacattaccgccaaatagggactatctaccatttcattgactttcatttgttgggatagatagcgtttcgtcatctctttcgtagcctgaagttgaatgtactgaatttgccctaaccctttgattttacaaaaatcctctaatgtcgctgacagcaatcctcgtaatgagccaaaggcagttaatacactttctgataaatccattacaggtatccctttaattcctgtgcgtaaaaagattgccaatagctccgcatcacttaaagcttctgccccaaattttagtaatttttctcttggcattaattcataagaactttcattcatattttttgttcaattagttaaaaagtgcaaacagcataaaaatcttccctccttgattcaaaaggctttttctcttttttcgacaaagatcgcaaaaatagggcgttgtgagtgagtacctatttgcgtagaatagcgaacagaaaatccatcataaagatgattcgttatgttaaaagataaaaaaatccttatcggcattactggcggtattgcggcttacaaaaccattgagttaatccgtttattaaaaacagcgggagcagaagtgcgagtagcaatgacccctgcggcagagacctttgtaacaccgctgactttgcaagctatttcaggtaatgcagtttcaacttctttacttgatccacaagcagaattagcaatggggcatattgaattggcgaaatgggctgatttagtggcgattgctcctgcaacagctgattttattgctcgactgcgtattggaatgggcaatgatttgctttccaccatttgccttgcgaccgcttcaccgattttacttgcaccagcaatgaaccagcagatgtacaagcggtcaattgtgcaggaaaatttgcaaagtttaatagagcaaggcgtttcgattattgggcctaacgctggctttcaagcctgcggcgatataggcaaaggcagaatgtctgagccgagtgagattttccaagcgattgaagatcattttacgcaatcgcaggatcttgctgacttaagcgtggtgattaccgcaggcccaacgcgtgaagcgatcgatcctgtgcgttatatcagcaatcacagttcaggcaaaatgggctttgcgatcgcggaagccttcgctaaacgtggggcaaaagtcaccttgattgcaggccctgttaatttagccacaccgcaaaatgttagccgtattgacgtgatttctgcacaacaaatggcggaacaagcggtgagtttggcacaaaaaaatgcaatttttatcggctgtgcagcggtcgcagattaccgtgtggaacagattgcagagcaaaaaatcaaaaaaacaggcgataatgatgaactgactttaaaactggtaaaaaatcccgatattatcgctacggtggcccatcttgctcaaaatcgcccttttgtcgtgggcttcgcggctgaaacgcaaaatgtagcagattatgcgaaagacaagttacaacgtaagaatttagatctaatctgtgccaatgatgtctctggcggacaggtgttcgggcaagatcaaaattcacttcatctcttttggcaaaatggcgagaaaattttaccgcttgcagataaaggaaaattggcggaaggattagtagcagaaattgtgacaagatataaggataaaaaatgaaacaaatcgacttaaaaattttagataaacgaattggcacagaatttccattgccaacttatgcaacagcaggttcagcagggttagatttacgggcattagtggagcaacctttaaccgtagaagcaggacagacagtgttaattccaacggggatttcggtttatatcgccgatccaaacttggcggcggtaattttgcctcgttcagggcttgggcataaaaacggcatcgtattgggtaacttggttggcttaatcgacagcgattatcaaggtccgttaatggtgtctctttggaaccgtagcgataagccgtttacgattgaagtaggcgatcgtattgctcagctcgtttttgttcctgtggtgcaggcacaatttaatatcgtagaagaatttactgcaaccgaccgtggcgaaggcggctttggtcattcaggtaaacaataggatagaaaatgacagaacctgtaatcaaaatgccgaaaaaatcggtaaaagaacgccaacagcaagtgttagaagttttaatcggcttacttaactcggaagaaggtatgcaacgtgttaccacggagcgacttgccaaagcggttggggtatcagaaggggctctatatcgctattttccgagtaaaaccaagatgtttgaggctttgattgaacggattgagatgacattaacgagctatatcaatgcaagtaaacgccaagaaaataccgaattggcagtaaaagcgattttacaaactatcttagaatttgcacaaaagaaccctggggtgacacgtattctaacaggacacgcattaatgtttgaagatgagttactcaaagcacgagtagccaaattctttgaaggattagagctacaatttatgaatttattgcaaatgcgtaaattgcgtgagggcagggcttttgctgatgaacgagcattgtctgtttacttggtgaatttctgtgaagggcaatttttacgccttgttcgctcaaattttggctttaatcaacatcaacattttgaaaaacagtggcaactgattaagccattattctactaggaaaaagatgattatcccttggcaagaacttgaagaaagcaccctatataatgttttagattcttttattttgagagaaggaacagattatggggagcgagaactcacactcgcagaaaaacgagaacgtttattagctcagttaaaagccgataaagttgtaattgtttggtcagaattgcacgaaagcattgatattaaagataaaaaatctttcttagggaatttgtaaatttatgctaaaattcttgacgtagtattaagctatatcaactataaatgatttatagaggtttctatgcaagatgtttcaatctcaaccgcacagcttgaagatgtcagcccattaccatccattcacgatcctgcggtggaatggtttttaactcactgtcatattcatcgttatccagcaaaatatactttaattcacgcaggtgaagatgctgaatcactgttttatattgtcagcggagctgtgtctgtctttatcaaggatgaagaaggcaaggagatgttattaaccaatttaggccaaggcgaatttgtcggtgaaatcagcctttttgaagaaaaggctcagcctcgcactgcttgggtaagaactaaaggtaactgtgaaattgctgaaatttcttataaaaaattcaagcaattagtgcatcttaatccagatattttgatgtatttatccgcacagatggctcgccgtttacgaatgacatcaagacaggttagtaacctagcatttcttgatgtaacaggtcgtattgctcaaacattgatgaatttagctaaaatgcctgatgcgatgactcaccctcagggtatgcagattaaaattactcgccaagaaattggtcaaatggttggttgctcacgagaaactgtaggccgtattttgaaaatgcttgaggatgaagggttaatttctgcacatggtaaaactatcgttgtgtatgggacaagataacatattaaaaatgcaaagtgctacgttagattatcaaatcaattaatctaacttagccttaaaacattaagatttccccccaattattagccccataaaaacttttgtctatacaccgaaaaaacctctctaaacctcctgattgccttgctacacatcgttccgcttgactaccccccttaaaaaaatacaatatatccattttggcaaacggtttcggaattcatttttctttgacaaattaaggtttaactatgcgctcctctattcctttatcactcactaataaaactctttctgcggcttcaggtaaaacttatcatcttgttgataaatcaggagaaccccttaaagtctttttcactaaaattgttgatgaacaacttgttattagaagaaatcagggattgttagatattataactttagttgggaatatgaaacgacggaaggtacccgtcaatcgattaaggctgatgcccatagggcagaacaaacatccttagtagtggatgatcgtgttactctacaggtgccatcaggagtgatttctattgccgcgacagctgtaaaaggaaatacgaatgttaccgctattggctcaggtagctatgaatataccattgcagttggatacagcaaagaagcaggctttattcctgatgttgatcgatatgtgagtattgtttagctggtgtgtattcccctcgctagcccccatccccctcgcaagctcgggggcttcccccataaatgggggaaggtgcccgaagggcggatgggggactcttagaagtttgtaaaaccatccctaaatagaaattttcctaaccaactgccgtactaaatccgggccttgataaatcatcgcagaatagagttgcaataaacttgcccctgcgttgattttttcttgccctgattgcaccgaatgaataccgccactgccgataataggcagtttgccgtttaactcttgagaaagttgcgaaataagttgagtgcttagtgcatttaacggtttgccacttagccccccttgctgatccgcaaaaggcaagcctgcgacgctatctcgtgaaagtgtcgtgttgccagcaataacaccgtcaatttggtgacggacaagactgtccgcaacagacgcgatttcttcggcggagagatcaggggcgatcttcaaaacaagcggcttgtaccccccaaatttttgcgaaagttgggcttgttcggctttaagtgagcgtaacagatcgtcaagtgcctcgccatattgcaaagaacgcagatttttagtgttcggcgatgagatattgaccgtcacataactggcgtgtggatagactttacgtaagcaaatttgataatcgtccaagctatgttcaatcggggtgattgcgtttttcccgatattgatcccaagaatgccgttatattttgccttttttacattttcaatcagcacatcaaccccaagattattaaagccgttacggttgataatgccttcggcttcaagaatacgaaactgtcgtggacgtggattgccgtcttgtgcaacgggggtgacagtgccaacttcaataaaaccgaaacctaatttagcaaagccatcaatcgcctcgccatttttatccgcccctgcggctaaaccgatagggtttttgaaacgcaaccccattacttcagtcggattgtcgggaagcgaacaagccaaagaaaacggggttttgccgaataattttaaagattgaatagcaaattgatgggcgttttccgcatcaagattaaagagtgcttttttgataagtgggtacatcatttgtatgaatataaaattacaattcttccctcgtttgagggaaagaaagaaaattcttttcccccgcttgcgggggaaggtgcccgaagggcggatgggggagaattaaatatccttttccgcccccatccccttcgcttcacgaagggacttcccccacttgtgggaaagaaagaaaattcttcccccgcttgcgggggaaggtgcccgaagggcggatgggggagaattaaatattctttccgcccccatccccttcgcttcacgaagggacttcccccatttatgggggaagaattaattttgctttctaaaaatcaatgccatacattagaaatcaaaaacccaacctttcggttgggcttttgattaatggctgaacattgcagaaatagactcttcgttgctaatacgacgaatagcttctgccaacattcctgataaggttaatacacgcactttatttaatgcacggatctccgcagaaagtggaatagtatctgtcacaatcacttcatcaagcgcatcattcgctaagtttttcgccgcactgccagagaaaacagcgtgtgttgcataagcaaatacacgacgagcgccacgctcttttaatgcttctgcggctttaactaatgtgccgccagtatcgatcatatcatcaactaagatacaatcacgatctgccacatcaccgataatatgcattacttgagccacattcgctttcggacgacgtttatcaataatcgccatatccgcatcatttaataattttgcaatagcccttgcacgcaccacaccgccaatatcaggtgaaaccacaatcggattaactaaatcggttttctttaaaatatcttcgattaacacaggcgaaccgaaaacgttatccacaggcacatcaaagaagccttggatctgttctgcgtgtagatcgcaagttaatacacgatccacccccacacttgaaaggaaatcagcaaccactttagcggtaatcggcacacgcgctgaacgcacacgacgatcttgacgagcataaccaaagtaaggaattacggcggtaatacgacctgccgaagcacgacgaagtgcatcaaccattacgatcaactccattaaattatcattcgttggtgcacaggttgattgcacaataaaaatgtcccctccacgcacattttcattgatctgcacttggatctcaccatcgctgaaacgacctactgttgcatcaccgagagaaatataaagacgttcagcaattcgttttgctaattcaggagtagcgtttccagcgaagagtttaatatcaggcattttggataaacctctagatgtagatttttaaggatataaattgagcgttttatgtaaaggggaaacatttctgccttgtgccacaaagccctcaacattttcaggttttagagcaaacacacggcgagcctcatcttcacaatcaaattcggcaaacacacaagcaccagtgcctgttagccgagacggtgcgtattgtaccaaccaatttagtagatcatcaacctttgaatacagatctcggacaattttttcgcaatcgtttgcgaaaggggcatcaagcagttctgctaaagtacgttttggagtatcacgagttaaatcggggtgcttaaaaatcgaagcggtcgcaatcgcctcatcgggctttaacaccacataccacttctcttttggctgacaaggcgttaatttttcaccaactccctcagcaaaagccgcaatacctcgcacaaaaatcggcacatctgcccccaaggttaatcccatttcagcaagttgctcaagggaaagccctgtttgccaaagctcattcaacgcaactaacaccgtcgccgcatttgacgaaccaccaccaacaccccctcccatcggcaagcgtttagtcaccccaatgttcgcccccaacggacaagcggtcttttcttgcaacaattttgcggcacgataaatcagattttgctcaacagccacaccatcaatctggttagttaaatgaataatcggatcttggcgaagctcaatctcaatctcatcaccaaaatctacaaactgaaacagcgtttgcagttcgtgatagccatcagaccgcttacctgtaatatacaaaaaaagattaagttttgcaggacttggaaaagtgaaagttgccatattagtacgcccaatgatcaatacgaattttcaaggtttgagaaccattttccaacacaatcaacttaggcaaatttggctggcgatcttcgtgatattccacaaaacgaactttccacaacgtcccattgaccgcataatcaaattgagccaactgacgtttttcattcacaacatagtttgactgttgctcaggctgacctttcacccaataggcaaattgatctatcgggaatgaaacgccgataatctcttccattaacatcgccacatctgcttcagtgcgagaacgcccctcgctatcagaaatcgtcattccatagacattacgttgcaatttcaatgatttgcttgataaatttgaagacatcgtcaacccaaagttcgtcggggttttatattgccaatcaaaatgggaagaaaaacgttcctcaggagaaatatagccaaattgccctttcgccgaataggcgttgatttgtgttaattgtgcaagatgttgttgccattttgcatcattatgtggaattgccaccgttggctgagtgatttcagtcggagcatccagcacagaatgacaaccagcaagggcaaataacagagtaagggatagcagttttgtgagttttttcatacaatcctcagatttgaaagttataatagtctcaataatatactatgaaactacaatcaaattattttaagaaaatatttgatatttactaaaaatggtgtgagatctacccgcttgtttctagctttcaacccgttcccccgtcggccttctccgcttaccaatattcttggtatctttatgacgggctttcactttcttcttcaagctctcttttttctcttctttctttttcttaatccgcgctttctcttttttcgacaccgtattcacctcaccatcttttggggctttggtgcgtggtgctaagccttcaataatacgcggttttaacggctcttccgtatagcgtttaattttgccaagtagcttgtaatcgtgagcttcgactaacgatacggcggaacctttcttgcctgcacgagctgtacgcccgatacggtgtagataagtatctgcactgtatggcaagtcaaaattaattacaaaatcgacatcatcaatatcaatcccacgggcagccacatccgttgccaccaacatatttaccatgccatcttttaagcgagcaatcgcttgattacgctgtgtttgtgccatttcgccttctagataagtcgaacgaataccacgtttacgcaaggtttcgcttagctctcgcacactttcacggcgacgaacaaacacaatgcttcgctcaatctcaaattcacttatcaaacgagcaagtaatttggttttatgttcaagattatctgcgtgataataccactgctgaattttcttacgttcacggcgacttggctctgcatcaatttgaacaggatcatttaaaatacgctcggcaaaatcgactaacaattcaccttcaagggtggcagaaaatagccaagtatatttacgccaacgggtttccgccgcaattttttcggcatcttgcccgaaccccatttgcaacatacgatccgcttcatcaaaaattaaaatctcgacagaacggcaatcaaaattttcttcttgaatatactgttgcaaacgcccaggtgtcgccaccacaaggtcttgattagtgttaaacacttcgccgtggttttgataagcaacaccgcctgtaatagtggcaattttcaagttggtaaattgtgccaactcttccgcttgctcagcgacttgcatcgctaattcacgggttggcgttaaaattaaaatgcgtggtggaccaggattgcggcgagggtgatcgagcaaatgttgtaacgctggcaataaaaatgcagcggtttttcctgtgcctgtcggggctgaacccaacacatctcgcccttccattgcaggcggaatggtttcttgctgaatagccgttgggcgtttatagccttttttttccaatgcttgcaacagctcagggcttaaatctaattcttcaaaggtggttaattcgttcattttgttctcttgttaatttttaagaaaatcagaccgcttgttcgtttaaaacttgtctgagtagtgttttgttcattggcacaacacctagttgtaattcaaaggggcgtaacacctgattgataatatcaatactgtaatttcccttatcattttctaaatcagataacgttttgcgagaaactttgacaatctccgcataacgctcttgtttcattgccagtagatgtaaacgtagatatttcaacgcctgccctaaactcatctcattgagcaatagcttacgagcaatttcgtctcgcacagtcgctctctgataaatatctaacgtttttttacttttagaggctctcgcctgtttgatctcttccattatgataataattgccaacgttttaatttttcaggtaaatagtccaaactgattgaaggatacgtcaaaatcgccgttggaacgccccttgcttctaaacgtgctttaagtccgacaagctgttgagccgtttgacgcaaagcatccaataacttgtcggctggacataaatcatcaagctgttctgcaatcagatcaaaacgatattcaccgcctaattctaatgcagggtgacctttactatcccacattgtcgtgcgaggaataccttcaggatctgctttcattggggcaaaatcataaattggagcaagccaaatacgattttgattgcgtaagaaagccgtatttcgcccgtgattatcgctatttccaaaggcgatattcaataaatctcgccttacccactcgatcacaaaagcttgtttatcaaaaaacattcctgtttcaaccaaatgagaggtttcaattttagcaatcaactgacgaataaccttttcgtgatccagcaaagagccagcccctttttctaacatagcataaacagattcaacggcataacgagccattttcccctgttcattacgataaacatcaaaacgaggtaaccacaacgacgggtaacgttcgccttcttccaatcgcatttttgtcgtatcaatcgtgtcaaaacccattgaggctaattcgtgataatagtgaaattcagctctcaatatatcgcaatctattacactacgtttcccacgcggaaacttgactaaatagaaatcgtcagaagaggcaccttgttgtaggttatcaatccaaacttgccgagtggctgtttggcgtagcaataatttcggtgcttcaccgccagcccctgtggcaccgccagccattgccccacgctgattagcgtattccaaaaagtctgcttggcgattgataacatcgtctatttcaaataagcgagagggttcattttcgacaaaagaactgaccgcttgcttaactcgtaaatgcccgacaggtgcaatcgtgccttgttttaataacaaatagttttgttgagccatcggcaaatgagcaatatctagtttttgcaaccaataacgccggcttgccccagaagggactatatcatctaaaaatgcaaaccagcccgatacactgcgatgcggaaaaaattccacagggtagttaaatgaaactgccttatcattatcacttaaaatttctgttaaatcatggagatagctaaaatcattgagactataatcagcctgaaaggtcaaaatagcaatatcctgccaacgatcagcaatgtaggcttgaagtataagcggttcgatttgcataaaaattctctacggtaaaaaatatcacgcattataaacagaaaaaggattttgtgatagttataagttacacaaaatccatttttgtcacttaacgagagatatatttctcattacatatataacgccatcaccaccgcattctctcgcccaccgtcttgggtagggtagtaattttttcgcaccgtcacttcattaaagcctagtgagtagtaaagtttttgtgcagtcgtgtttgaagctcgcacttcaagccataatgtcgtgatctgcttttgttgaagctgaacgatcaacgcttgcaacagttgcttaccaaagccttttccttgataggcaggatcgactgtgatattaaacagtgtcgcttcatcaagcaaaaactgacagatcgcaaaggcaacaatatgattttcaacggataatttcaaattcaaatagcgttcgccctgactatttaacagcgttcctttcgcccaaggcactaaatgggcttgttgttcgatctcaaaaagacggtcgaagtcgttttctaaaataggttctatcatacatactctcaaaaatgggacgtgattataccgctaaaacaccatttcatcacgcacaacatagcctgattgataatagcctttccagaaatcactttctttcgtctgtaatatgttgctcaatagcattaaaaacatcgtccccgtttttgtacaacattgatctaaacggaattcgtaaagcgatttataccacgaataccgtggaatcgcttaatagcgtgattcgtcgcgtgattaaaaaacgaaatgtattcccgacggatgattcagttttcaaagtgatttggcttgcgattaaagatgcatcaaaaaaatggacaatgtcgattcagaactggaaactggcaatgaatcgatttatgattgattttggtgatcgcctagacgatcaccgttaagttgaaatgggtgtttacacagaatttgggataggctcctttgttttctttaacaaaggcatttttctattccactgaattaaccctgttctgccaaatctaacatttcctgagcattcgctaacacagcatcggtaattttttctccccctaacagtcgggctaaggcttttactcgttcttttggtgttagcaaactcattttggtttctgtttgattattctcaacttgtttttgcacattaaaatgatgattaccgtgacttgccacttgcggtaaatgggttacacacaacacttggcattttttgcctagctggcgtaataatctgccaactaccgttgcagttggtccgctgatcccaacatcgacttcatcgaaaataatcgtcggcgttgaaagtttattcgccgttaaaacttgcaccgcaagggaaatccgtgataactcaccaccagatgcaattttagctaatggttgtgcattttgccctaagttactgcgaagattaaattcaacgaaatccgccccatttgcggataatttgtcgagattatgctgaatatcaatgaaaaattcgccgttttccattgctaattgtttaatctgtttggtcacttgggctgacagtttttgccctgcatctacccgcttgtgataaattttttctgctaattcaacacattgttgataggcttgttgttcatcggcaattaactgttcttcattctctgcaaaatctaataaggtttgtagctcttgttttaagcctaaatgtttttgccatagtttatcaggggtaatgtgatgtttgcgagccagttgcattgtttggctaatgcgttgatctaattcatttaatagctcaggatcttgctcgattttattggcaagatgattgatttcagagctggcttcctgtacttgaattaaggcttcattgagcatttctaatgccgattgatattggctatcgacttcgactagctcttccaaatcccgaatagcacgatagagcattgtatctacattggcattatcatcacttaacaaattcaatacagattgtgacagttccgttaattgctcggaattagcaaggcgagcgtgatcttcttctagttgctcaaattccccttctttaatcgcaaattcatcaagttcttccacttgatattgcaaaagctgtttgcgagcttcattctcttgacattgttgatggaaatttttcacctgtttatgcaattttcgccaactatgatattgcgttgccatttccgctaataatgggtgtaaattggcataattatccaccacttcaagctgatactcacttttcagcaagagctgtggggcgtgctgaccgttcaaatgaataaggtattgcccaagctctcgcagttgtgaaacagggattgggtgattattgacaaaagctttggaacgcccttcttggttaatcatacggcgtaaaatgcactcttgtggattatcttcatcaagtagctcgtgttcctttaaccataaataggcagggctagtaggttgcatagaaaatgtcgccgaaatatccgctttatctgcaccattacggatcattgagctttcagaacgatagcctaagcataagccaagcgcatcaatcccgatagacttaccagcccctgtttcccctgtaatgacggacattccttcatttaattcaagggttaggtgacgaacaatcgcaaaattattgatggttaattgagttagcataagaaaatacccatacgaaacactgtatgagtatatagtatcactgtttttatacacagtaaataaaatacagaaaattttatggtaaagaataggacaaatttattgttattttggaagatatattcagatgcaatgtacattacaaggaatacatccgaaattagcccaagtaatagggctaatttcagattgttgacaaagatatctatactatttccatagcttaagataaatattaactacaccaactccgccctcaatttcttttacgtccaccatcacttgcaactgctcaatggtttctttccagactcgggtttttaagccgcaatctgggttgatccataaacgttcttttggtaccactttcaaggctttacgcaacaagtgttcgatctcttccgcttttggtacgcgtgggctgtgaatgtcgtacacgcccaggccgatgtcgttggggtaaacgggggaatgataaaactcgaaataaaatttatttttaaaacggtaaataatagagattggtggaataatagagttgataccgatgcggatgaacattcacacttaaaacgcagccgttttgtaccttactttggtttaacttacgatcttaatgaaaacaatagcttatatttaagttataccagtattttcaaaccaaatagctcaatagatcgttatggcaatgtgttaaaaccggtattaggcaacaatcaagaaatcggctggaaaggcgaatggtataacggacagcttaatgcaactgtggcgttgttccaaattaaccaaaaaaaccgccctgtctatattgatgatgccacccataaaaatgggggatattacggcacattaggcgaagtacgcagtcgtggtgttgatgtcgaaatctcagggaagatcacagacgattggcaactgtttgcaggttatacatttaatcaaagcaaatacttagaaacggaaagttctcgctatttagccggaacaaattatagtaaacatacaccaaaacatatgttccgcctttatacggactataatttaccattcgacagcaaaaaatggtcggttggtgcaggggtaatgatgcaaagcgaaacggatagtttatactcggtcaaacaaggcggttatgcgatttgggatgccaatatccgttatcaagtcagcaaacatattgccttagggattgtcggaaagaatttaactaaccgcaaatactatgaaaacaatcgtgtcagaaccttaggtatcaataatttctacggtcaggaacgtaccgttgtatttaacttagattggaaattttaattagtaaattttcactcggaacagaccgcttacaagcggtctgttcttttctcttttttgcaaaacgatgaaaacacttcgacatttcaaacaacttgctacgccattttggtttcgccgccagcaatggtttgagtggctattacttgtagcaatgcttggatttgcccttttgattattagggtaagcgtatggattactgaatggaataagcttttctacgatgccctggccgatttcaacggcaaagtgattccccaactagtgctaaattatttgagttatattacgttgattgtagcttttattgtattcggcaactggatacgaaaaatcctgattttccgttggcgagaacatttgaccaagcaatttcagcaacaatggctaagccagcacaaccactatcatttgactttttcaaacgatattgataaccccgatcaacggattgcggaagactgttttttattcgctgaacaaagtatcgacttattcaaatattttgtgatgaatgtagcaaaattaggggcttttatcacgattttatggcaaatgtcttgcatgcaacagttttcttttgcgggagtggattggactattcacggctatttagtttggattgcattgctttactctctgatttgtacgctttttatgcattttatcggacataaattacaaggtttaaatgttgagcgtcagcataaagaagcggactatcgagcaactttattgcgtattcgcgacaattcggagcaaatcgccttttatcacggtgaaaaacaggaaatttcacgattatctgctcgttttcaggggatcaaacagaattggtttgacttaattaaacgagaaatgaaagtggaaaccttctccgccacttacctacgtttaagcctgtttattccaattttagcaaccttgccgatgtatctcgcccgaacaatgacatttggcgatatgatgcaggctcgtagtgcattttccaatgtgcaagacggtttcggttggtttatggattactataaacgtttgattgaatggtcggcagtaattaaacgtttagccgattttcaggaacgcttaaccaaattagagctacaaagtacatcgcacattatttcatcttctgattgtagccttgaagtagataatcttaccgttcaaacaccgcaaggcaaaccactgtttgcaaatttttcactcaaactgaccgcttgcgattgggttttactagaaggaaaaagcggtattggtaaatctacgctgctcagaaccttagcgggtttatggcagcattatcaaggcgatattcgtcttcaagctcgttctttcttatttttaccgcaaaagccttatttagcggaagacagcttacgagccgtgctaagctaccccgatgaaccgcttaatgatgatgtcagattgcaatgtcttttaaaacaagttggcttatcacatttagcggattcgcttaatgaggtacaagagtggcaaaaacggctttcaggtggcgaacaacaacgcatcagtattgctagagccttattacatcgccccgatatactttttttagatgaggcaacaaatcagctggacgatgaatctgcttgctatttaatgaaacagttacagaaagaattgaataatagtatttgtattgcgattagtcatcaggaagttgtgcaatcattatttagaagtagatgcttaatattgccgtaatgcaagccttactctttcgagcctcaagcggtaagattcattcaattttttgcaaaaaatgatctaaatcttaccgcttgtttatatccaaatttgtttagaacttgtagttaacacctaaacttatatttcgtcccatttgtggaatataaggtaagaaggtttcatgggcatacacttcttcattcagtaagttattcgctttgagaaatagctcgtactcccctttcgctaatttgttttgataagtaagcccaagattcagcatattatgcccttgcgtgacattttcaaattttgaaatgcgatgttgcgtgaagacatgataatactctaattcacctttgagattttcagtaaaatcacttttaatgcgagccccaacccgaattgggggaagacgtggggtgtacattttcgcttgctcttcatacactggttcttgtacacgaatttgacgctcaattcccatttcgtttctaactttagaagctgctcgccatggtttcattttcggattttcctgcatcagtttttctactgctttggtaaactctggattatctacataacttactttatcgctggtacgaatatcgtgggcttttaagtaaccttttacataatcaccgaataggctgatatgatgttttggtgtaacttgataaccaaaattaacttccacaccatagaagcgagcaggagcttgcatatagcgattaatgcgtaaatcgctatcttgcttcattgaagcaggtcctctccctgagttgagtgtatagagataggtatagttatcaaagttgtataagaacccactcagataatagctaaatttatcgccttcatagcttaatcctaaatcaaggttattagatttttctttgcttagccctttattacccatttcaaatgagtttgttgccaaatgcatgccatgcgcatatagctcttgtgcgttaggaagcctttcttggtgcgaagcggtcagagagagcttatgattttctttaaatgcccaatgcgcacctagcgcaaaagaatgtgctgtttctttatgtgcttgggttaaagtatagtaattatccatggcatgagctgtttccggtcttttactatcaatatatccaagagagagaaactcattacgtactttttcatgatcgtaatctttggtgactttttgtttttctaaacgtgcagaagcctcaaaggtaatatcattccattgataactttctaaaccgaataaactccagttctgcattttgttattgttcaataactgctgtacgccacgatgtttgtgcttatgtgttgcagaatcttctggagataatgcactatttttttgttcaaggtattgaatgccccatatccccgttaaattcccgattgggctatgtacaaattccagacgagtggtgagccctttatttttaaagagatttgctgctttttctccctctatttctccgtgctgataatttacatggcttgcgttaaatctcaatttatctacatacttaaagggttcgataatctcgcctctaaaatcgtaacgctgacttttcaaatcgacataaggcgtagctgacaaaccatgggcatgacaatccgccatatttacgcctggattagcccaaaagagatgtcgatcatcggcaagttcagggtaagggaataaatagggatattgctgtttaacactttcattaataatccttaccgcacagccttcataaatatgattatgagcgggtaatccatatttatcttggcgctcggtataggcaagccctagatagcctttttcatgaacccaagagatgccagccgtgccgacttgtgattttgcccaactttcagggacatgtgaaagattttgatagctcatctctctacgattaaaggcttttttatctgcataagtgccataacgataatgtggcgttttgtagttccctgcttgttttgataaaccttcaagatgaacggctatattcggatgaatggcaaaggtaacacctgcggtggtcaatttttcattgttattggtattaaaacggaaacctatctcgctcttaagtccattctgtggcatgaaattcggaattttattatcaagtacgttgattacccctgcagcattgcctgaactgtatagcaaggtagaaggtcccctaacgatttcaacttgtttggataatgttgtatccaccgttaccgcatgatccggcgacatagtggacatatccaccacatcactattattttgtaatatcttgatacgcttaccttcttgcccacgaataatcggcgctgaagctccgccaccatactggttagaatgaattcctaactcactagataaagcgtcccctagtgttgttgatttctgtttgaatacttttccatcgatcagcttatcacttacattcgggcgatctcctagcaagttactctccgccactttggcttctacctgaatttcctcaagttctgccacttcttctgcatatacacatacagaaaaaatagaaattattgaaagcgttatcgcattttttttcattttgtctcctttagataaattaaccatatttttttatggaataataaataaaaaggagaataaaatcaattaaagcttaatttttttatggatttgataacaaggaaaagggcgttaaatataacgccctagagtaaatcttaaaattaatccaactccgccctcaatttcttcgtcacgtccaccatcacttgcaactgctcaatggtttctttccagcctcgggtttttaagccacagtccgggtttacccataagcgttcttttggtacaactttcaaggctttacgcaacaaatgttcgatctcttccgcttttggaacgcgtgggctgtgaatgtcgtacacgcccgggccgatgtcgttcgggtatttgaagccggcaaaggcggtaagtagttccatatcggaacgtgaggtttcaatggtaatcacgtccgcatctaagccggcaatcgctggcaaaatgtcgttaaattcggaataacacatatgagtgtggatttgggtgtcatcttgtacgcccatatagcttaaacggaaggcttcgcccgcccattgcaaataagcgtcccaatctgaccgcttgagtggcaagccttcacggattgcaggctcatcaatttggatcactttgatccctgccgcttctaaatccaacacttcgtccgataaggctacgccgatttgtttgcacaccgttgaacgtggaatatcgttacgcacgaatgaccattgtaaaatcgtcacaggccctgttagcattcctttcatcactttgttggtgaggctttgggcatattgcgaccaacgcaccgtcatcggttcagggcgagccacatcgccataaatcacaggcggtttgacgcagcgtgagccgtaactttgcacccaaccgaatttggtaaaggcaaagccgtcaagcaattcgccgaaatattccaccatatcgttacgttccgcttcgccgtgaaccagcacatctaaatctaactcttcttggcggcgaaccacatattcaatttcttttttcatcgccgcttcataatccgcaaggcttaactcgccttttttgaaactcgcacgagcgtggcggatttcgctggtttgtgggaacgaaccgatatttgtcgttggcaaaagcggtaagtttagccacgcattttgcttcgcaatacgcgttgcaaatggcgatttacggcgatctgccccttcaggtaagttagctaaacgtgccgccacttctgcacggtggatctcttttgatgttgcacgcgcatccgctgccgcttggcttgccactaattgtgcttgcaccgctgttcgaccttgttcaagtgcggtcttaattaccgacaattcttcaactttttgtagcgtaaaagcaagccattgataaagttcaggtttatttgcttgtaattgcgtttccaccgctaaatcaaaaggcgtatgtaacaaagaacagcttggggcaatccacaaacgttcgccaagtttggcttttaatggctcaagcagatctaatacttgatttaagttcgcacgccaaatgttacgcccatcaatcacgccagccgaaagcactttgcggtaatcgtcaaatgtcgcaagttgttcaggtgcgcgaactaaatccaaatgcaaaccgtccaccgctaagcctttgagcaattctgcgtgttctgccactgagccaaaataggtggctaataacaatttcgcatccacttggcttaattcctcatagaccgcctgataagccgccaaccattccgcaggtaaatctaaggctaaagccggctcgtcaatttggatccattccacaccttccgccgcaagtgcggttaaaatttcacggtaaacaggcacaagtttgtttaataactcaaagcgattgaaggcttcgcccttctctttgcctaaccaaaggaaagttaaaggcccgacaatcacaggtttaaccttcaaacctaaagctttcgcttcacggatttgattaacgtagtgagctgggttggctttaaattcggtgtttttatggaactcaggcacaagatagtggtagttggtatcaaaccatttggtcatctcaatggcaaattgatctttgttaccacgcgccagttggaagtattgcgaaagggttaaattttggctgtcaaacccaaaacgcgcaggaattgtccccgttgccacttgcagatctaaaatatgatcgtaaaaggtaaaatcgcccaccgctacgaaatcggcgtttgccgccgcttggtgctgccagtttttctcacgcaaggctttggctaaatctaataaatcttgttctgcgatttcaccacgccagtaacgttcctgtgcaaattttaattcacgtttcgccccaacgcgtggaaagcctaagatgtggaatgttgtcataatatgttctcctttgatagatttgatatttcttttatttagacgtttagccgtctaaatggctagttgtataatctacaaaacaacaacattatgcaagttcataattttcacaaacattatgaaaatttttcatggtaacttatacacccaagctcgaaaatcattcaatataccttatgggtatagatggaatagatagagattttttctctaaagatttattagtatttcttcaaaatccacttcaactctcaacgcctctaacatcgctttccccctcggcagcacttcaacctccgccaacaacgccaccgcttcactcaaactgctagcggttggataagtcgcattttttgcaaaaaattcggcacaatcgaccgcttgttgattgaatagactaaacagcagttgttgcagattttgttcgcgtaaacaagttgggactttttgaatggtaaggcgagtttgcccttgccactgttttgtttgaatatcaaaacccaagtctgccaaagcggtttgcgattgttgccaagacgctgtttgctgttcatcaagggttaaacttagcggtatcaacagagcttgattttcccttttggctaactcagcttgtagttttaattgagccaatttttcaagggaaagcagataaaaggtttcgccctgtttcatcaacaatgctttctgtttcactaccgctaaggcttgagcatagggcgtggccggctcggctatcggttcaacaagcggtgtgatcttggctatttttgacaaatcttgaacaggttctgaccgcttatagtcttgcataggtgacgtagaaagcaattcgccataccacttctgttcgcttttgcttacccctgatgagcgagtattgctgtaatttgggcgttctgcgtgagttgatgaagtcaagcgtggttcacgataactgtgagcgaaaatattctgccccgaagccacacggttggtgtcggcaatataattcggcaatgcttcactgacattcgttgtcagcggtaaatgatgttgatcttcaagagcattcaaaacaccttggtagataaaatcgtggactaaacgactttgatgaaaacgcacctcgtgttttgcagggtgaacattaacatcaacgtggcttgggtcaagatctaaaaatagcacaaaagcagggtaatgatccttcggcaaccgttccccataggcttggcgaatagcatggttgatcgttttatctcgcatcattcgcccattgacgtagctgtaacagagatcgttttgcactctcgctaaacttggtgagccgacccagccgtaaatatgtagatcgtcgtgttgccaatcaatgtgtaccgactgctgaataaactcatcaccgcaaatcgttgcaacccgtttttgttgctgttcaagctgttgtgtcgccaccgctttatagtaacgcacttttttctcattatgggttagcgtaaaagtcacattcggttttgctaatgcaatacggcgaaccacttcatcaatatgggcaaattcggttttatcggtacgcaagaatttacggcgagcaggggtattgaaaaacaagttagccacttcaatagtcgtgccgacagggtgagaagtaggcttgatttcaacctccatttcacgcccttgtgcataggcttgccacgcttctgcctgatattcggggcgagaagtgagcgttaaacgggacaccgagctgatactggctaaggcttcaccacgaaagcccagacttaaaatactctccagatcttcaagggtagcaattttgctggtggcgtgacgagccaaagctaaagcgagatcttgcttgccgatcccacagccgttatctcgaatacggatcaactgcgatccgcctttctcaatatcgatctgaatttgcgttgcccctgcgtccaagctgttttccaccagctctttaaccaccgacgcaggacgttccaccacttcgccagcggcaatttggttggcgagttggggagggaggatttgaataaggggtttagatcctttaacgctcatatgtaagaaaaatagagataatttgaaatagattctatcacaaataatatttattacgttgagtatcaaataaattctcttattctatttctatgcttattagaattagcttttacacattaaattttatgagatttgatacgatgcttactattctcaaatagataagctgtaggaaagcatttttatgcaaatcaaaaaaaccgaccaagcggtcggttttccaaaaaatttgcaaatttgtttaaaaaagcaattacgctaattttttgatttgagcagctaacttagatttgtggttagctgctttgttagcgtggattaagcctttagatgccatacgatccacaactttttgcatttcaacgaaagctgcttctgaagctgctttatcaccagttgctactgcggcgtatacttttttgatgaaggtacgcatcattgaacgttggcttgcgttatgttggcggcgtttttctgattgaaccgcacgtttttgtgctgacttgatattagccaaggtcaaactcctaaaaatatctgtgtaaaaataaaaacataaaaaacaattttttatgcagtgctatcgatagtttaaattcattttcaacgagacacgggcttgaaaataacatcgtttcacacaagaagtgttcttgagtaaaagataggggcggattttagcagtttttttctgattttcctataacaaactgctaaaattccgatcaattttttaagaagataaagagaacaaattgtgagcaagaaattattacgatcaggaatgattgtcagcggtatgaccctactttctcgtattcttggtttagtacgtgatgtggtggttgctaacttactgggggcaagcgttgctgccgatgtgtttttatttgccaaccgcattcctaactttcttcgccgtttatttgccgaaggggcattttctaaagcctttgtgcctgttttggcggaatataatgccgataatgatccagacaaaactcgtgaatttattgcaaaagtatcagggactttaggtggattagtgactgttgttaccttagtcgcaatgattgcatctcctgtgattgccgcattatttggtacggggtggtttttagattggctcaatgatggacctgatgcagaaaaatttacccaagcctcgttgttactcaaaattacatttccttatttgtggtttatcacttttgttgcattatcgggggcgattttaaattcgttaggtaaatttggtgtaatggcgttttcccctgttctgttaaatgtggcaattatttgcgttgcaatttggggaaaagatttctttgcctcgcccgatacggcacttgcctgggggtatttttaggtggcttatcacaattcctattccaaatcccttttatgaaaaaggaaggtttattggttaaacctaaatgggcttggcacgatgaaggggtaaagaaagttcgcaacttaatgattcctgccttattcggtgtatctgttacccaactgaacttgctcattaatcagattattgcctcatttttaatcacaagctcaatcagttggctctactatgctgaccgtttaattgagttcccacttggattattcggtattgctatctctacggtgatcttgcctagcttatctcgtattgccaaacagaaagatttgacggaagaacaacgtaaatttaactttgagcaaacaatggactggggtgttcgtatggtattactgtttggtattcctgcgatgattggaatgatgatccttgctcaaccgttgataatgacgatgtttatgcacgggaaatttcaactcaatgatgttatcgcttcttcgcaagctctgtttgtgatgtgctttggcttaattagctatatgttaattagtattttggcgaacggcttttatgctaaccaaaacaccaaaacaccagtcaaaatcggtatgattgcagcggtaagtaatatctgttttggtgtactggctattcctttcggttttattggactagcaatggcttcggcactttccgctgcggtaaatactggcttactttatcgtggcttagctcaaaagggcatttataaagtcacaacaaccacggcaatttttacccttaaactgctgattgctgcctgtgtaatgggggcgttagtgtcctatttttctccagatttaacaggttggaacacattgaatttttgggcgaaagtccattggcttgcgtggttaattgtacttgctgcaatcagctattttgccactcttggggtgcttggtgtgcaaataagatcattcaaggtaaattaaagtgactatttttagatcgtatagcaatatgagaatatacattgctacacgatattttgtacattaactttcaatcccctcaaacaacaaggtacttaaataacgttctgaggcggaaggtaaaatggccacaattgtcttatccgcaaattcaggtaattttgctaagcgatctgcggcagcgacagctgcaccagatgaaatcccgaccaaaataccttcttcggctaacaaacgacgagcggttgcaatggcggtttcgctatccacttgctcaacacggtcgatcaaacttaaatccaagtttttcggaataaagcctgcaccaatgccttgaattttgtgtggacctggtttgatttcttctccgtttaacatttgtgtaatcactggcgactcggctggctcaaccgctacgctgatgatttgtttacctttatcttgcttgatataacggcttactcccgtgatcgtaccgcccgtaccaacacctgcgacaaaggcatcaatattgccttctgttgcttcccaaatttcaggacctgtcgtctgctggtgaatggctgggtttgctggattttcaaactgtttaagcataatataacggttcggatcactcgcaataatttcttcagctttcgcaatcgcccccttcattccttttgccccttcggttagcaccaaatttgcccctaagccacgcagcaatcgacgacgctcaatactcattgtttcaggcattgttaatgtcaatttataaccacgagccgccgctacataggctagcgcaatgccagtgttaccactggtggcatcgacaatttccttatctttcgtcaagataccatctttttctgcctgccataccatatttgcaccaattcggcatttaacactaaaacttgggttacgagcttctactttaaccaataaattcccgttgtgaccgaaattctttaaacgaacaatcggggtatttcctatcgtttgtgagttgtctgcataaattgtcattgttatgttcctcgtgctagtttgaatgcggttagcatacggatttttagcctaatgttaaggataagaatggcatttaatataactaaaagaaataacaagcggagattttctcagggaattttgcaaccactgacgcaagtggtatagtaaccctttatttctaatgcttagatttaccaatgaaaaaacagcaatccactcaaaaacatacgcttactcagctcatttcccttgtggtgatcggtattttttccgtcattacttggtttaacaatgaaaagaaagaacaagaacgtaagcaaccaacgccagcaccaacggtttcacaaagcaccaacaatgttgaaatcccaagccagttaggcaattacgataccaatatggcaaaagataagtttgggcaaaacctacaagcctctgtggattactatatgttagcactttcgtggtcgccaagtttttgcgaagaacagagaagcaaaaataacggcaacgtcccagctcatcttgcattgcagtgcaaccaagcctcgaaatttggttgggttattcacggtttatggccacaatcggcaactgcaagatcagctgatgaacacccacgtttctgccaaggcgatttggctcaactacctgaaaatctgattaaacaatatctaccagagtctccaggggcaagtttgttacaaggacaatgggaaaaacacggagcctgtgcgttcaataatgcagaagactattttgagaaacagaaacaacttttccgtagcctcaacctaccaggacaagaactctcacgcaaagaactatttgcgtggttaaaaaaatttaacccacagcttaaagaggcttatcttggagccagtcgcaacgaactttatatttgttacgacaagagctggaacgtaatggattgccctcgctagtgcaacatcttcgtgaactcaaaatgcaagtccaacgccagttaaaacgagatttggacaaggcaaaccgctattttaacaaacactttacgcccccaacggtaagttacaccgtacgagggagaaaggctggagtggcttacttgcaacaaaatgaaattcgcttaaaccctattttattgagtgaaaatagctcaaacttcgtgcaacaagttgtcccacacgaacttgctcacctgctggtttatcaacaattcggacaagtacagccacacggcaaagagtggaaaatgatgatggaagaggttctcggcgtgcctgccgaaacgtaccattgctttgatgtaaccaatgttgcgggacaacaattcccctaccgttgcggttgccaaacgcattttttatcaatccgccgtcataacgctattatgcaacacaagcggtcttatatttgcaaaaaatgcaaagagatattggtgttgaaggtcaagtgaacattgctacttaagaaaacgttccatctgaatcataaatgtcgacttttaggtatagtagacaaattttttctgaactgttttgtctactatacctaatatctcagggcaatcgatatagctacaaagcattttttaaagcctctcgaataagttgctcacttgttgattcagatttcctgtttacttttttaaccattttttcagcatctgctgccttatatcctaatgaaatcaaagcatcaatcgcttcatttactgggctcatagacgccattgataaaagatttcctgatggttgtaaaatagaaatttcatgatgaaataaagttgaaaattttcctttcaattcaaccaacaaacgctctgccgttttacgtccaatccctggtattttgataagttttgctaattcttcctgttctatagcagacataaattcagaaactgacattgctgacaaaatagctaatgctaacttaggccctacaccgtttgttttaattagttcacgaaatagcatacgctcttgcttctgaacaaatccaaataaaaggtgcgcatcttctcggattaccagatgagtgaaaatcatggtatcttcattaagatcaggtagattatagaaactagtcattggcatcaatacttcataacccactccttgaacatcaagtaccattgatggaggagatttttcaataatcctaccacaaagtcttccaatcatttttgtttatccattaagtaatagggcaattagaataatagaaaataagatcacagtattttattttttaatacacaaataaaataaatttcccgatagataaccattctgaaaggaaaactgagatcaaaaaggctgtgttccgtactcctaaacacaccctaaaccacagattctctaatttaccgcaaaattatttcggtgcgccgattggcaacacagtgcgtccaaaactttcgttaagaatttcagcagctgctaaatagaatgctaataacgcagttaataagccgaagttaccaccaatgtgagtaatagttgcattgtgagtgaaatcacctgctgctaataggtagaatgtgatggtaagagcaaggaaaatcgcttgtaatgcacgcggttttgttaaggtgccgaagaacatcattaaggtaaatgtaccccaaactactaagtaccaaccgataaattcaggtgatacggttgcaccgaagaacacttttaataatgcaaatgaccaccagaatgaaccatagctgataaatgcagtgaaaccaaaagtgttaccttttgaatattcaaacatacctgcaatcatttgtgcagtaccgccgaaagcgaagcccattgcaagcactaagcctacattttcgccaccgaaagtaccgttgttgattaaacttaatagccacgttgttaatgcgaaaccacataaaccaagtggaccaggatttgctgttgctgtattgtgagcagacattttttaacctctaattaacgttttgttctaagtaaattccagtatttttcataagtttcaacggcatcgccgacatcactttgtaaaacacctttttcaatttctgcaagcggtgggaaaatcagtggatcttgcactgtttctgcaggtaataatgccttcacattttcgttaggcattgagaaacccatcgtttcaattaccatttttgcactttcaggacgcagcaagaaatcaataaatttatgtgctgcttccttattttttgcatttttaggaatgacgtaattatccatccaaattaccgccccttcttttgggaagataaattttaagtctggattttcactcttcgctctatatgccgaacctgtccattgcattccaatcgcaacttcgccttgtaaataaggcatttcaggagaatccgagttaaatacaagtacatttggcacaagttttgttaaacgctcgtaagcagttttaatttcatcagcattagtggtgttcggtgatttaccgtctaacaataatgctatatgaaacacttcacgagagtcattcatcagcaataccttgcctttgaattctggtttccataagtcgccccagcttgtaatcatgtttgggtcaatgtctgacgcattcacaccaatacccgttaagccatagacataaggaagtgagtatttgttttcagggtcaaactctttacccattaaggctttgcttacgttgtggaaattgcttaatttgcttttatcaatttctgctaacattccatcttttgccatttttccaacataatagcttgacgggaaaacaatgtcataacccgacccattcgttaattttaactttgagtacatttcttcgttactttcaaaggtggagtagatcacctcaattcccgtttctttggtaaattgttctagtaaagaagatggaacatattctgtccagttatacacatacaatttttcggctgcctgcgcagtgagtgccaaaaatgcaacacctgcgacagaaagtttattcaaaaatgattgagcaaatttaaccaatcttcaaatcctcttaatgaaaaagataaataattcctttgcaaatatcagcagttaaacacccgcttgtttgcaaattcctcttgctgaaaagcggtgaagtatagcgattttatggcgatttttctatcaaaagttatcaaatgaaataaaaaaagcgacccgaagatcgcttttctaacaagagactatgcctcacagctactacaacttaacaagttgcggttaaacacttgtgccgcactcattgagtattggtagtaaattgattttaagcccaattcttctgccgttaagtacagttggtttaaatcacgagcaggggtagcagggtgcaccataatgttaatactttgcccttggtcaatgtatttttgacgctgtgccgcttgctgaataacgcttaactggctgatttcagagaaagttttaaagacctctttttcgtgttcagagagctgtgttaaatgctgaacagaaccatcgttcaataagatgctatcccaaatttcttcggtgtctaaccctttttctttaagaagttgctctaagaatgggtttttataaaccgttttaatcttagctaagtctttaacatagtagtttgacttaaacggttcaaccgatggcgatacactgcctaaaataaagctacttgattttgtcggagcaatactcatcaaggttgtattacggcgaccatatccttttaacaattcaggttcaccaaagcgttgagctaactctttagaagctttaagggttttctcttgtaatgttttaaagataatattgttcttttgcattgcttcaaagctatcaaaagcaatattgtttgcttgtaaataactatgccaacctaacacaccaattcctaatgcacggtgacgcttagcaaagcggtttgcacgatcaaggaatggcatattttcacttttctcgataaattccgacatcaccacatctaagaaataggttaatacttcaggtgcatcggtatctttccactcatcaaaatagagcaaattcattgaagataaacaacaaacaaaactttcttcattatttgacggcaacataatttcggtacacaaattcgaagcgtgaaccgtcatatttttatctttatacacatcaggacgaccagcatttgcattgtctttgaagaacagatatggaatgcctgtttctgttttacgttgcaaaattttcgcccaaagttgtcgcttgtatggatcacctgctttcattgactcaagccagtcgtgtccaacacatacgccatagtacattaactgaattggattaccttcggtgtgaatatccaaccactcatcaatgtcgccgtgttcaatatcaatgtagcctgcgaattgtcctttacgagaagtaccttgtgaaataacatcgatcaccgtatcaaacaacttactgaagttaaatgaaccgtctgattttccgttatttttaatcaagctaccacgcggacgaatatcgccaaaataggctgatgtaccgccaccgattttactcatcatacccacttcagcggttgtcaccataatttcgtggatcgaatcgccaatatagctaccaaagcacgaaatcggtaggccacgatctaaaccgaagtttgaccaaattggcgaagagagcgagaaatagccacgtcccatatagtagtagaacttgtctgcatagccttcaatacctagcttacgctctgcgtgttctgcaataaaacgaatacgatctaaagcagttgtcccttccaacaaatagccacgttgcaagaaaagacggctgtcatcattcaaccactcaaaatcaggacggtttacgttagtgtagccaagttggaacaactttggctgataataatcattagaataagtcatcggcggtaatctgtttcatttttttactataatcggtactacgtttgttaaagaaatctgtttctttagttgaaatgatttcaatatcaaaccactctgtttcttttaacaaatcaggatctacatcgtatggtggttctaaacctaaaatagataatgaattgttatagcgattcataatatagttttcgacggttttacgagaaataaaacttaaatcgccctcttcaaaaatccagtctaaaatacctctctcagcttcaaaggcttgttgagataaggttttgagttcttcaaaaaactcaggggtaaataattcactatgctcatcacgcaaaatttcatataacgcaataccaaaacgcccgtgaatttcttcttcttttgaagtagcttccactgcattagagatccctttaaacagatttttatgcttgttgaaagacatcataataatgaactgaccaaacaacgaaatatgctcaacgaacaacgagaacagcacaagagatagcacaaactgccctttgcctgtatctttttctcgcataaaatcttccatataacgaatacgtttcatcaacggctcaatttccgtgatttgcgtaaacatatcgttcaagcctaatttttctaacaagaaagagtaagcatctttatgacgaacctcactttccgcaaaagttccccccacatcgtccatctctggtttcgggaagtaacgatataactcaccccagaaacgtttaacatttacttccacctgtgaaatagccagcattgcacgggttaaaacgtgacgttcgtggtcgttaatattagtacggtaatcttgaatatcccccgtaaaattaaattcggtatgcaaccagtacgagtgacgaattgcatctttaaactcaagtaattcagggtattcataaggtttgatttgaatgcgtttttcaaaaatgttgcgtgccataatgatttgagcttcgtggttgattattcaatggggagtattttagagatattttttcgttctacaagatcttgacaaatggctatccctgattgtgtcgtcctagtgattgattttaaaagaaaaaattttttgtaaaaattcagtttcgcttaaaaaaactatatcttgtgtttttaaaagttagaaacacaagatatagtggttgtaagtggtgggattatgctcttattggtcctttaccttattattccctcagcccttatccagttaccttaaaaattaatccatctcactcatcaaacttgcatttccgcccgccgcggcagtgttaatgctgattgctttttcgtgtagcagtgggaataatgaaagagcaaggtcaagattttcaacataggtaagaattgcccctgtgcgttctgcatagtgagccttttcttccaatgaaagcggttcaagcacaatcaagctacttaaatttgctaaactgttgaaatcattgctaataatcactaagcctgcaaaatgctgagcctgtttagccagtggtgagtgagaatgtaccacagcacggctacccgataccacgatggcagtcaaggcttgaatttgttgctctagtgagccattgccgattgcaataacaggacgagcttcaaattgcataaagtttacttcccctgtaatcccttgcattttaaagattttccctaatggcgactggcgagaaaggcttgcaataagatcttgggcattttgtaattctgtgcctgaaagcaccgcttgtatgcctgagagtaagcctgaagtgtcggctggtttgcccccttctaaacccgataatgtccattcacggcgatcaactaagcgttgtagataaagtggaccaccagctttcggacctgttcctgataatcccattccgccaaatggctgaactccgacgactgcccctacggtatttcgattgacatagagattgcctgcgtgaatactgtcaatccataaatcaacggtttcatcaatacggctatgtaagccactggttaagccaaaacctgtcgagttaatgtctgccatcacttgaggtagattatccgcatcaaatcggataacgtgtagcacagggccaaatacctcgtgttttaattgattgatatgctcaatttcgagtagcgtcggtggtacaaaaatgccagtttgagccagttcgagatcaatcggaacttgatagcacgatttcgccacttttttcatttcgtcgatatggttgagcaaacgttcttgagctaccttatcaatcactggaccaacgtccgtattaagattttgcggtctgccgacttttaactctgccattgcccctttgagcattgtgaggatatgctctgcaacatcacgttgcaaataaagcactcgcaatgcagaacaacgttgtcctgccgaatcaaaggctgagtttaaaacatcagcaaccacttgttcagctaacgcagaactatcgacaatcatcgcattttgtccgcctgtttcagcgataagcggtacgatatgggctgatttttgcaaattgcgattgatattcttagccgtatccgttgaacctgtaaaaatcacgccattcactcgtggatcactcactaaagcagaaccgatcacttttccactccccgttaagcactgtaaggcttgctcaggaataccagcttgatgaaataaactcacggcataatatgccattaatgaggtttgctctgcaggtttggctaataccacattaccagctaccaacgcagaagaaacttcgccgacaaaaatcgcaagtgggaaattccacgggctaatagcaacgacaatgcctctcggattgcgatagtcttcagggttttgacgcacttcttttgcataataacggcagaaatcgaccgcttcacgcacttcggcaatcgcattatttaaggttttccctgcttctcgtacggctaagtcaaagagctgtggcatattggcttccatcaagtcagccattttttcaagtgcttcagctcgtactactggggaagtgttttgccactcagctttaaattgttctgcaacagcaaaggcttttgccacatcattttccgtagcatcgatcacttcaccaaccacttctgcgatatttgcagggttgcaaacttggcgagaatgaagattttcagttttttcgcctgcaatttgcggttcagcacgatattgttggcttgcaaattgatttaattctgcctctaatgtttttaagtggatcgcatcggttaaatcataacctttagaattttggcgttgctccgcaaaaagtttaactggtagtggaattttcgggtgcattgtgcctgcggttatttgggctttagcgacaggatcgcaagctaaatcatcaatgctaagattttcatcgacaatttggttcacaaacgagccgttcgccccattttctaacaaacggcgaaccaaatatgctaagagcgtttgataagaacccacaggggcataaattcggcattgcacattcagattatttgagccaaccacctcatcatacaaggtttcccccattccgtgtaaacattgaaactcaaagtgcttaccttgggctaaatggtaaatggttgaaagagtttgagcattgtgagtagcaaattgtggataaatgacatcttgagcagataacaattttttcgcacacacgatatagtttaagtcggtatggactttacgagaaaatactggataaccttccgcaccatcagcttgagcgcgttttacttcactatcccaataagcccctttcactaaacggatcatcaattcacgatggttcgcacgggctttctcaatcaaataatcaatcacataagggcaacgtttctgatacgcctgaaccacaaaaccgataccatcaaagccagctagatcaggatcagcaatcaaacgatccattaaatctaaagaaagctcaaggcgatcagcctcttccgcatcaatgttcaaaccgatgtcgtactgtttggctaacaaaaacagatcttttaaacgaggataaagctcatcaactacccgcttgtgttgagctaaactataacgagggtgaatagccgagagcttaaccgataccccagaagatttatatactcctaaaccacgagaaaccgctcccacagcgtgaatagaagctacataatcatcataatagcgtttagcatcttctgcagtgaatgcagcctcacctaacatatcgtaactataacgatagcccattgcgaaccgcttttctccatttttaatcgcttgctgaatggtttcccctgtcacaaattgtttgcctaacaaacgcattgctacatcaacccctttacgaataagcggttctccacctttctgaataaggcgagaaagtgaagaggatagactactttcactgtgagtagccaccagtttacccgtaacaactaacccccacgctgccgcattgacaaagagagaagggctattgccaacgtgggaacgccaatcacctttggcaatcttgtcacgaattaatttatctgccgttgctttatcaggaatacgcaataacgcttcagcaagacacatcaatgcaacaccttcttcactagatagagaaaattcgtgcatcaacgcatcaacaccactggctttctgacgagcatttctgactttttcaacgagttttttagtaagcgttttaatgccttcggcgtgttcatctactctagcttgtggaataagttgtttgacgagttgctcttcatcacaacgatagtgttcgcttaaggttggacgaatagcggtagcttgaggcaaaatatgataatgagatatggctgacattgtttttctcccgtttcattgttgttattgagatgattgcaaaacatcgctgcaatctcaccgcttgttaaaagcaaaaaacggcttgccaaatgacaaaccgtttctagataaattatttcattgcatctgcataagctttttcagctttatcaaaagtttccacgatttctgctttaggggcaggggtaatcaaagaaaccacgatgattgcgataaaggcaaggataaatccagggatcatctcatagatagcactctctggtaataatttatcccagaatactaccactaaagccccaactaacattccagccattgcgccagctgcattcattcgcttccagaaaagcgacagaataaccacaggtccaaaagcacaaccaaaaccagcccacgcattttcaactaattttaatacttggcttgttggatcttgggcaatagcaatcgcaatcactgaaatcacaagaaccatcatacgacctaaccaaactagctctttttgacttgcatttggtctaatcatacctttatagaaatcttctgtaatcgcacttgaacagatcaacaactgacaacttaatgtactcattaccgctgctaaaattgctgataataaaatcccaacaatccaaggattaaagagtaatttagataattcaataaagacttgttcattattttgattaaccacagccgcctgttcaggatttgcgaagaagtaggcttgcccaaagaagccgatccctaccgcaccaaataaacagataatcatccaagtcatactaatacgacgagcatttggcattgatttcacactgtctgcagccataaaacgcgctaaaatatgtggctgaccaaaataacccaatccccaagcagctaaacttaatagaccgacaaaggttgtgcctgtgaatatatcagtaaaatccttaccgacatattgcccagcagcaataatcacattatgcgtatccgcaaagccacctaaatgaattaacacaaaaataggggttaagaaaagagcaaataacatcagactagcttgaatagtatccgtccagcttaccgctaagaaaccaccaataaaggtatagatgatagtggctaatgcaccataccataacgctgtggcatacggcacgccaaataaattttcaaataatcttgcccctgcgactacgcccgaagcacagtaaatggcaaagaaaaatagaataatagtagcagacacaattttgaggatttttgtgttatcgccaaaacggtgatggaaatagtcaggcaaagttaaagcattcgcattgtattccgtatgcatacgcaaacgaccggctacaaataaccagttaaggtaagcacctatggtcaagccaattgcaatccagccctcaaccaaacctgccgcataaaccgcaccaggtaaacccattaataaccagccagacatatctgatgcccctgctgataaccctgttacaaaactacctaatcgacgaccgcctaaaatatagtccgataaattattcgtaaatcgataagcaacaaaaccaattaagaccattccgataatataaatcagaaacgtcgttgttgtcggatcaaagccaaacataaggtttctccctagtaatacaaaattctaaactgtctaatatagcagaaatcacagcatcttaacttttccttttaatcaactgactactatctgtcctacatcttaaatttgttcaagtatagaacaaaaaaatttattttgtaacatttctttaaactttttttaattaaaattatacaaaaataagagtattgtatattcaccctatttatttgctctaaccgttatcaaggacaacctcttttaaaattttccctaaaaacaaaaaaccgcaggctatctctaacctgcggtttcttctctttaataaaaccccgacgatgctctactctcacatggggaatccccacactaccatcgacgttacagcttttcacttctgagttcggtatggaatcaggtgggacaactgcactattgtcgtcgggaaaatcttttgatgattctctctatcttcttttttctgttctttaagggcaaatataatttgcccctacactattcttattcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtctccaacaacccttacacacttattgtgtgggagaactcatcttaaggcgagtttcgtgcttagatgctttcagcacttatctcttccgcatttagctacccagcagtgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttactctttgggaggagaccgccccagtcaaactacccaccagacactgtccgagaccgcgtttcgcaatcttcgttagaacatcaaacgttaaagggtggtatttcaaggacgcctccacaatcactggcgtgactgcttcttaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgactggttcagccttcggaggtatactcctacaacctacgccagcgcaccttctcccgaagttacggtgctattttgcctagttccttcacccgagttctctcaagcgcctgagtattctctacctgactacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttccggcgaacgagtttttcactcgttttatcgttacttatgtcagcattcgcacttgtgatacgtccagcaaacctctcgattcaccttcatccgcttacacaacgctcccctacccaacaggcgtatcactaataatcctctcttcgattactttccgactcaacgttcgggttgcttgaccaacatctctttccgtttcacttcattcgatgttgttaatcgtaaggcgtattagtgatacgcctgatgccgcagcttcggtgctatattttagccccgttacatcttccgcgcaggccgactcgactagtgagctattacgctttctttaaatgatggctgcttctaagccaacatcctagctgtctaagccttcccacttcgtttcccacttaatatagactttgggaccttagctggcggtctgggttgtttccctctccacgatggacgttagcacccaccgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactatccgcccagttaagactcggtttcccttcggctcccttattcagttaacctcgctacaaaatataagtcgctgacccattatacaaaaggtacgcagtcaccctttcgggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagtttagtaccacaacataaacttcgaatacggggctatcaccctgtgtcgcttggcttcccagccaattcttctgtctttgctgttatcacttgctggctctttcgttttcgctcgccgctacttacaaaatctcggttgatttcttttcctcggggtacttagatgtttcagttctcccggtttgcctttcattactatggattcataatgaaatgatggattcttcatccatcgggtttccccattcggatatcttggattaaacgcttcttatcaactcatccaagcttttcgcagattagcacgtccttcttcgcctctgattgcctaggcatccaccgtgtacgcttagtcacttaactatacaacctcaaacatttttatctaaaagaaaaaacatttaagactgatattaactactaaacacttaaccgcttttgttcagttaagattttcttactactcagactttcttgtttcagggcaaatatgatttgcccctacagaaaatctctcagttttcagcttgtttccatatttttaaagaacaattcgataattacttatctttcgacaaaaaaatcatctttaaatggcgtccccacggggattcgaaccccggttaccgccgtgaaagggcgatgtcctaggcctctagacgatggggacatcatttaaagatgctttccttcatgctgtcaatttgcaaattttatcgcaaatctgaccgcttgtgtctgttttcttgctctattccttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcaccctctgtatgcaccattgtagcacgtgtgtagccctactcgtaagggccatgatgacttgacgtcatccccaccttcctccagtttatcactggcagtctcctttgagttcccgaccgaatcgctggcaacaaaggataagggttgcgctcgttgcgggacttaacccaacatttcacaacacgagctgacgacagccatgcagcacctgtctctaagttcccgaaggcataaactcatctctgagttcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagcaacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtagtgctctattaaaacaccacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaactggccttgcggtcccagtctttcatctcccgatactacgcggtattagctacagtttcccgtagttatccccctccataagccagattcccaagcattactcacccgtccgccactcgtcagcaaagaagcaagcttcttcctgctaccgttcgacttgcatgtgttaagcctgccgccagcgttcaatctgagccatgatcaaactcttcaatttaaaaagtttaatcgctcaatatgtactgactataaaaaatcacgactgaatttattcaatcattatgaatttcaagttaagcacctatcaagacttcaaaattaaaaaatatttttaaacaaagtcaatcaacaagtgcccacacagattgtctgataaattgttaaagagcaaaaaagaacgacgcactgtcaaatttaactactcacaacagcgcgtcgttgtgtggtgcgaattatagagaaatcctaaaccaacgcaagtacttttttaaagtttttttctaaatgttttgtttttcaccaaaaaataaaaaccacaagatgtaacctattgattttaaacaaaattatttttcaacaaaattcagtatatttaagcgtttaaatccccaattctgcattaccttttctctttttaggaagttttcactattttgcgtacaaaatgcctgattttctttgttttcgttattcacattcctcttcacatcttgtaacaagctcactacacggttcgcaatcccattgcccggatcaacaaaaaaactcacccgtggcaatagttgttgcaactcttctttgaccaatgggaaatgggtgcaacctaaaatcaccgtatctagcgtcgggtgtgattgccattcttcaacaactttttgcaagcgtcgcatatccaccgaacccgtttgctgtttttcttcgacgatttccaccaaatctgttgagccaatgcgttctaccacacaatcttttgcatagcgttcaatcaactcatcgacataagggcgtgttaccgtgcctttggtcgcaagcaaaccaattgttttggtttgagaaatttgagcggcaggcttaatcgcaggcacagtcccgacaatcggcattgcaaaccgctctcgtaaggcaggtagcacaaccgtactggcagtattacaagcaacaaccaccatatcaagcggataattttctgcaattttttgcacaatacctaccgctagttcgatcagcaccgcttctgatttttcagaataagggaaatacgcgttgtcaaaacagtagagataatgggcatctggcagattttcacgaatagcatcgtaaatagtcaaaccacccattcctgagtcgtaaagaagaattgttggtttcattatattttgtaattaaagaacttcgagcgaatgctacgcctttcttgatgtggtttcaaatgaaaattgtggcagaaacagctctcgaatttctaacggataacctttgagtagcaatgttgaacggcgagcatataagcccgtctgcttgtcttggctccattccaaagttaaacgctgtggattttgcggaaatagccacaaaccaataggattatctcctagggttaaaacggcttgtgccacattctcaattgtttcttccgctaatagcgtttgagcaaaaatccacaccttatcatcaccacttaacaccacttctcgcacccacgtttttgcaaaatattgctcaaatccgaccgcttgccagccctgttgaacaacttcaacgtctagcctttgacaaatttgttgcaacttttcggttaaagagttcgtatgtaacagccattctgcaacttgacttggcaaacccgtttccgccgtctgccaagttgatgtggctaataaggttcgatactgctcgaaatcctgcatttaagcccctagctgtttgagcaaaatctgctctaacacatcatagccttgctgagtaaagtgcaatccgtcgtgacacaggtttagatccaatttgccttcttcattagcaaaggcattccacgttttcacataacgaatatcggcagggcaatgtgcttcaaggtattgatttaacgccaaaatcgcaggattgtctgtggtcgcaatgttattcacaggagttgcttctaataaatagtagcgagatgttggggctaacgttttaaaggtggacacaatctcgttaatccagtctaacacttgcttcggcgaataatcaggttcttttacaatgtcattcacccctaaaaagataaacacatcttcgcctaactgtttgattaaattacctttaacaatcaaatcaaggtattgacgagtgctagtaccagataaccctaaatttgccaccgttttacctgcaatattcggcgtgccttgttccatatcagaccacatatcaaatagtgagtgaccaacaagggtaatttgagctgttttatcaaactcagtctgtttgcttaatgccctgtctaaaatgtcttgatctgttttcatatgttatcctttgtctaaagtaatgattaaaaaccatcctacacaacaaatcccactttcttatacacgtcggctaaggttgctttcgcttttgctctcgctttttctgcaccttcacggtagatattttcaagcaatgcttcattgttacggaaatggtgataacgttcttgaagttggcttaacattgcggaaacttcgtcggcgacggcagtttttaagtagccgtacattttgccttcaaattctgtttctaattcaggaattgtcttgcctgtgacgcttgccaaaatatcaagtaggtttgatacgccaggtttattttgaacgtcgtaacgtacaacaggtggctcatcaccgtcggtcattgcccgtttgatttttttcgccactgattttggatcttctaataaaccgataacgttattacggttatcatctgattttgacatctttttcgttggttcaagtagcgacataattctcgcccctgttttggcaataaagacttcaggcacagcgaagattggctcaaggacatttccctctgcgtcttttttgccgtataacgcattaaaacggttagcaatatcacgggtgatttctagatgttgtttctgatcgtcgcctacaggcacttgatttgcttggtacagtagaatgtctgccgccattagcactggataagtaaataagcccacgtttacgttatcttcgtggcgagctgatttgtctttgaattgtgtcattcgccccatttcgccgaagtaggtataacagtttaagatccaagcgagttggctatgttcaggaacgtgggattgaataaaaatagtgcttttggctggatcgataccacaagcaaggtaaatggcgagtgtatctaaggttgctttgcgtaacgcttctggatcttgtctcactgtgatggcgtgtaaatcgacgatacaaaatagacattcatattcatcttgcattttaacccagttacgtaatgccccaaggtagttacctaaacttaattcgcccgatggctgtacgccactaaatactattggttttgacataatctttctctttttagtaaaaaatctagcggtgtgattttggcagaaatttgctaaaaatgccaagtattcaaccgcttatcatttaaggaattaatcctcaatccccaaactttcccagatttcatcaacacgtttgacgacatcgggatttttggtaatcggcgttccccattctcgttgggtttcacctgcccatttatttgtggcatcaatgcccatttttgagcctaatcctgcgataggggacgcaaaatcaaggtaatcaatcggtgtgttttcgattaatgtcgcatctcttgctggatcgcaacgagtggtaatcgcccagattacatctttccaatctctcgcattgacatcatcatcacacacaatcacaaatttggtgtacataaactgccgtaaaaacgaccaaacccccatcattactcgtttggcgtgtcctgcgtattgctttttgatcgtgactaccgctaggcgataagaacagccttcgggcggtaagtagaaatcaacgatttcagggaattgcttctgcaaaatcgggataaacacttcattcaaggcttcgcctaagaccgcaggctcatcaggcggtctgcccgtgtaggtggaatgatagatggcatcttttcgcattgtaatatgcgtcacggtaaacacagggaaatactcttgttcattgtaatatcccgtatgatcgccgtaaggtccttccaatgcggtttcgttaagatcgatatagccttcaagcacaatctcagcactggcaggcacttccaaatcattgctgatggatttcaccacttcggttttgtgtccacgcaataaccctgcaaatgcatattctgataaagtatcggggatcggcgtgacggcggctaaaatcgtagcaggatctgcccctaatgcgaccgaaacaggaaacggcttatcgggattagcttctttccactcttggaaatccaacgcaccgccacgatgcgatagccaacgcataatcaatttatttttagtgattaactgctggcgataaatccccaaatttaaccgctttttataaggaccttgcgtaatggttaagccccaagtgacaagcggtgcgacatcaccttgccaacagtgcataatcggcagttgatacagatcgacatcatcacctgagatcaccacttgctgacattctgctttactcaacaccttacttggcatattcagcacttgtttccactgtggcaactgcccgatcagatctttaaagccttttggcggttcgggtgcttttaagaacgccaacaacttgcctagctctcgcaaggctttggtatcttcttgtcccatacccattgccacccgttccggcgtgccgaatagattgcacagcacaggcattttgtagcctttcgggttttcaaataagagagccggaccacctttactcaaagtacgatccgcaatctcggtcatttccaaataaggatcgatctcttgagtaatacgcttcagttcgcctttttgctcaagcagatcgagaaattctcgcaggtttttgtatttcattggattctccattgcaagaaaatgcaattttaataaaatttctaatctagagaaataaaagagctgaccccagtatgatactgaaatcagcccattaaaactatctatttaaagatatagccacactatttggaatataatgcaataaatacaactaaactatttacttaaattatcaaagaagtttttcacccctttgaaaaaaccttcgtgttttggtcgatgttgccctttgccttccagactttcttctaatttacgtaacaactctttttgttcttcattaagcgatactggggtttcaataatcactttacagattaaatcccctgcatagccacctcttgcactggttacgcctttaccacgcacgcggaacagtttacccgtttgggtttcggctgggattttgagtttcacgcgaccgtctaatgtcggcacttcaatttcgccacctaatgccgccattgtgaagctgatcggcacttcgcagtaaaggtttgagccgtcacgcacgaaaatatcgtggtctttaacgtgaattaccacatataaatcccctgctggagcgccgttttcccctgcagccccttcacctgataagcgaagttggttgccagtatccactccagctggaatggtgaccgaaaggtttttagttttctcaacacgtccgtcaccgtggcaagatttacacggtttctcaattttcttaccagtgccgtgacaacttgggcagacagtttctgtcataaagaaaccttgttggcgacgaactcgtcctgagccgtgacagtgtggacaggtttcgactttgcttcccgcttcagcaccagaaccgtggcaagtatcacattgaacaagagttcgaatgcgaatatcttttttcacaccacgcacggcttcttcaagggtgatttctagatcgtagcgtaagtcatcaccacgcacgacacgttggcgacgaccgccaccaccgaaaccaccgccaaacatttcgctgaaaatatcttcaaagccgccgaaaccgccaccgccaaatccgccgaagccacctgctccgccaccgtgttcaaaggcttggtgaccgtactgatcgtacattgcacgtttttcgttgtcacctaatacttcataggcttctttaatttctttaaatttttcttcagcttctttgctgccttggtttttgtcggggtgatgttttgccgctaaacgtttataagcacgtttaatctcttgttcactcgcccctttttgtaagccaaggacttcgtaataatcttttttactcatagtattttttgtaaatttttaagaaaatttgaccgcttgtaacctaatctcgttatattctgttttctaacgaaaaaatctgcttatttagaatttcatcaattttggctcgatccaaccctgaatttatcaaagtgagttctaacgttttcatttgttgtttaaatgcttcttttgctttatgtacattttcagcaataaaatcagcattgagatcgctttcgatacgataaaatttgatgttggaaacacaaggataaaaccaatcaaatttagcagttaaatcctgaatagcaatagtgccatgtgcttcactaataccttctttccccaaataaacacttccttgtagatgttcaaaaccgtgtttttcaagcgtatttcgaatatcgtagtaagcgttattatagtcatttccatggtaattatcttttagacaatttgtatccatatcaaaagtgattaggtatctactcatattcaatttccaataattagattttatctaaaatgttttttgatgataattaggacataatcaacgcagttttcaacggtatcatcaccatttaacttttgagcctgtatttcgagttttctttcgcagatatacaccaaaagggcgtgttgccacgccctttgtagggactacgtctatggacacacgcagtgtgcccctacccgtaattacttgttgtctttcacttcttcaaactcagcatcgaccacgccgtcgtctttttgactttgttgggcttgttgctgaccttgttgagcctgagcttgacctgcttggattaacggctcggacgcttttacgagggcttcgattttcgcttcgatatccgctttatcttcgcccttcgcagctttctctaatgccgctaccgcttcttcgatcttcgctttatctgcatcagcaaggttgctgcctgcttcagcgatctgtttacgagttgaatgagcaattgcgtccgcttggttgcgagtttgcactaactcttcaaatttacggtctgcttctgcattcgcttccgcatcacgcaccatttgctcgatttccgcatcgcttaagcctgaagatgtttggatcttaatttgttgctctttacctgtgttcttatctttcgctgaaacgtggataataccgtttgcgtcaatatcaaaggttacttcaatttgtggcataccacgtggtgcagggttaatgccttcaaggttaaactgacctaatgatttgttatccgatgcacgtttacgttcaccttgtaaaacgtgaatggttactgcactttgattatcttccgccgttgagaacacttgcgattttttcgttgggatcgtggtgtttttctcaattaaggttgtcatcacgccccccattgtttcgatacctaatgataacggggttacgtctaacaataatacgtctgttacatcaccagctaatacgccaccttgtaccgccgcaccgatagctaccgcttcatctgggtttacgtctttgcgtggttctttgccgaagaagtcagccacttttttctgtactaatggcatacgggtttggccgccaactaagatcacatcgttgatctcagatacgcttaaacctgcatcagctaacgccacttttactggctctaatgagcggtttactaaatcttctactaatgcttctaatttcgcacgggtcacagttaatactaagtgttttggacctgttgcatctgcggtgatatacggaagatttacttcggttgattgtgctgatgaaagctcaattttggctttttccgcagcttctttcacacgttgcattgccattgagtcattgcgtaaatcgacgccttgctctttttgaaattcttcaacaaggtagttgattaaacggttgtcaaagtcttcaccacctaagtgagtatcaccgttggttgcacgcacttcaaaggtttgttcgccatctaagttatcaatttcgatgatagacaagtcgaatgtaccaccacccaagtcatacactgcaacaatttggttttcttttttagagtctaaaccgtaagctaatgccgctgctgttggttcgttgatgatacgtttaacttctaaacctgcaatacgacctgcatctttagttgcttgacgttgagcatcgctaaagtaagcaggcacagtaataaccgcttcagtcactggctcacctaagaaatcttctgcagttttcttcatttttttcaatacttccgcagagatttgtggcggagccattttttcgccttttaccgatacccacgcatcgccattgtccgctttggtaatctcaaacggcataatttcaatgtcacgttgtacttcagaatcagtaaaacgacgaccgattaaacgtttaatcgcaaataaagtatttttcgggttagtgatcgcttggcgttttgctggctgaccaactaaggtttctttgtctgtataagcaatgattgacggagtagtacgcgcaccttctgcattttcaattacgcgtggtttgtcgccatccattactgcaacacaagagttggttgtacctaagtcaataccgataatttttcccataatttgattcctctaatataaatttggttgtttgtttaagttagctacaagattgtgctttttcgctacatttcaagagcaattcaaacatttttcaaaaaagaaacgggaagttgtgctacgttcccgctcagacggaacaataaatagggataaaaatgtgggcttcaagggtaaaactaaaaaaatttaaaaaaatgtgtattatcacacacacgcactatttctcactacggcacaatcaccgtaaacacataagccgccatattaaccaaaagcactacgccataaagcatattcgatttgccgtgattaagagaaaccatcacaacgaaagcagataatgcgagtagcaccattgatttccaatctaagcctaacaccatattaatatcaaatagtaagcagacgatcacaacagacggaatagttaaaccgatactggctaacgctgaacctaatgctaaattcacactggtttgtaatcggttacggctggctgcggtcaatgctgccaaaccttcaggcatcaaaacaacagcagcaataatcaccccgactaaagataacggcgcacctgcagcaaccaccattgtttcaatcgcaggggaaagccctttcgccaacattacaacgacacctaaacagatcaccaatagcaataaactgactaatgctactttagtcgaaggtggctctgcgtgatggtttggattatcatcatcggctaagaaataatcacgatgacgcacggtttgcatcataataaaagagaaatataaaacgagtgacgcaatcgcaacaaataccaactgagagctggtataagtcccccctgccgagctggttgtgaaattaggcaaaatcattgttaataccaaaatagacactaaggtcactaaagcggtactcactgattttttatggaaaaattgaacgtgatgtttaatgccgccaattaataagcaaccgcctaaaatcccgtttaaaatcaacataattgctgcaaataccgtatctctcgctagataggtagcattgtcaccgcctgcgatcatcagcgacacaattaatgccacttcgataatcgtaatggcgagtgctagaataatagtaccaaacggctctccaactttatgtgccacgacttctgcgtggtgaaccgcagaaagcacgctaccaatcaataacgcacctcctccaagttgtagccaaatgttctctttcacgccaacaaaatagatagcccaagctgcaagcggtaagatcaccgaccaaattggcaaaggggaatgggaatgtgttgccataatgtcttctcctttatttttatcgtttaacaatcctgctcttttgtactcataatctcaataatttgtctatccatatagaccatactttttgtcgcaatcgcacataggttattgattgatttatcaacgctatgttccacgataccttcattgccggtcactcggctattatctaatgccactaacacagccttataggcagaagatactcccgttgaaactttcatcgcacagctgtttgctgccccgtcacacaatacgccactgatgtcgccgatcatactgcaaatcgccatactaatggcattaaaattgcctttcaacaaatacgccataccagcagcactgcccattgccgccgtagtcacggaacaaagagcggatagttttggtaatttactgtgaatatagatcgcaatagtatgagaaagaaataacgcacggatcagttgctcatcatcagcattcacaaagcgtgccacaatcactgacggcattgttgccgcaataccttgattgctcgatccagaattgctcatcgcaggcaacaacgcaccgcccattcgagcatctgacgctgtcgtggtttcaatcacaatacgtgataataaatcatcagacatcaagccaagttcaatctgttttttcaaagttcgtccgatatgcaaaccatactctttttccaaaccttctttagataacgcagaatttaatttagccgcttcggcaataaaggcaatctgttcaagaggaacttccatcgcaaattgataaatctgttcggcggaaagttgattgaaaaagtgataatcgtctgctatttcaaccgcttgcgtttgttgctggaacaacacttccccatttttctcaatcaacaccacattggtatgggtatcttgaatacagactttgacccaacccgtttcgcctaacaacaaggcttccgagtaaagcggaaaatccacatttgcaatatctacactcacttggtttgcatctaacatcgctttcgctttggcgacatcgtcagcttgaatatgtttcaacacttccaaacctgccgttgcatcacctgcaatcgccccacagccgccacaatcggcaatcccaccatacctgttccaggtacggtaacccccataccgtttttcattaaatttggggacactttagcctgaatttgaacaggctcgccacctaagtatgatttcgcaattgcagccgctaacgccaacgaaatgggttctgtacagcctaatgctggggcaacatctcgtttcacaatggcgattaattgttctgcaaattcaaatttattcattcttttttctctttagtaaaattcctctctattctaaccgcttattgcataatcaaaaagcaacttttttgcttgcttttaattgcataaaaatgcattattcaaacataattattcattataatatttaaatttattttctgataattatcacttgaacgcaaacgtttgctctagtaaacttagccgcctattcctgagtaagagattaggcagcttacaaaatgacagccaaaatttcaataattaggagtacatataatgtctaaacctgccattttagttcttgccgatggctctgtgtttcacggaaaatctattggttatcaaggacataccattggtgaagtggtctttaataccgcaatgacgggctaccaagaaattctcaccgacccttcatacactaatcaaattgttacattgacttatccacatatcggtaatacaggaacaaatagcgaagacgaagaagccgataaagtgtatgctgcaggtttaattattcgtgatcttccccttattcatagcaatttccgtgctaactcttccctttctgattatctggttaaacataaaatcgtcgcaattgccgacattgacacacgccgtttaactcgaattttgcgtgataaaggcgctcaagcaggctgtatttatgtcggtgatgatatggctaaggctctcgaacttgccgacagtttcggctcaatggctgggcaagatttagccaaagaagtgacctgtaaagagttatatcaatggacggaaggtgaatggcaacttggcaaaggttatgtgcaacaaactacccctgaatttcacgttgtcgcttacgattttggcgtaaaacgtaacattttaagaatgcttgcggaacgtggctgtcgtatcaccgttgtgcctgcaacaacctctgcagaagctgtactagccttaaacccagacggtgttttcttatctaacggaccgggcgacccagagccctgcacctatgtaattaccgctatccaaaaattattggcaacgaaaaaaccgattttcggcatctgtttagggcatcaattactcggattagccgcaggcggtaaaacgaaaaaaatggcattcggacaccacggcgcaaaccaccctgtacaagatttagacacacaaaatgtgctgatcaccagccaaaaccacggttttgaagttgatgaagcgagtttgcctgctaacgttcgtgtcacccatcgctcactctttgacggcacagtccaaggcattgaactcaccgatcaatcggcattctcgttccaaggacacccagaagccagcccagggccgcacgatgtggcatacctgtttgaccgctttattgatgaattgagaaaagcgaaaggttaataagcggtgagatttgaagggaattttgcaaaatttcgctgaaaagtgaccgcttgtattcaagtcccctccccctcttgcgggggaggggattaaatagtggtggatattaaaagacaaccaaattcaacaacagagaaaaactatgccaaaacgtacagatataaacacgattttaattattggtgctggtccgattgtgattgggcaggcgtgtgaatttgactactcaggggcgcaggcgtgtaaggcgttgcgtgaagaagggtataaagtggtgttggtgaactcaaacccagcgaccattatgaccgatccaaatatggcggacgtgacctatattgagccgattgagtggcgaacggtggcgaaaatcatcgaaaaagagcgccctgatgcgattttgccgacaatgggcggtcaaacggcattaaactgtgctttagatttatctcgtaacggggtgttaaaacagttcaatgttgagctgatcggggcgagtgaagatgcgattgataaggcggaagatcgtggtcgtttcaaacaagcgatggaaaaaatcggtttgtcttgcccgaaatcttttattgctcacacccttgaagaagccttgaaagcacaggaagcggtcggtttcccaacgttaattcgtccatcatttacaatgggcggttcaggtggcggtatcgcttataaccgtgatgaatttttagcgatttgcgaacggggatttgaagcgtctccaacccacgagttattgattgaacagtctgtgctcggttggaaagagtatgaaatggaagtggtgcgtgataaggcggacaactgcattatcgtttgttcaattgagaacttcgacccgatgggcgtgcatacgggcgacagtattactgttgcacctgcacaaaccttaaccgataaagaatatcaaattatacgtaatgcttctttggcggtgttgcgtgaaatcggcgtggatacaggcggttcaaatgtgcaatttgcgatcaaccctgaaaatggcgagatgatcgtaattgaaatgaacccgcgtgttagccgttcttctgcccttgcgtctaaagcgacaggcttcccgattgcgaaagtggcggcgaaattagcggtgggttataccttaaatgaactgcgtaacgatattacgggcggtttaattccagcttcttttgaaccaacccttgactatgtcgtgaccaaaattccacgttttgcctttgaaaaatttgcgaatgcggacgaccgtttaaccacccaaatgaagtctgtgggcgaagtgatggcgatgggaagaactttccaagagagcttgcagaaagcgttgcgtggcttagaaacggggatttgtggctttaacttgctatcggaagagcctgaaaaaatccgtcgtgaactggcaaacccaggtccgaaccgtattctttatgttgctgatgcttttggtgcaggctttagcttggacgaagttcatcactattccaaaatcgatccgtggttcttaattcaaattcaagatttggtgcaagaagagcttgcccttgagaaaaaacagttaagcgatttggatcgtgaagaattacgtcgtttaaaacgcaaaggtttctcggataaacgtatcgcccagcttactaaagtcagcgaaaaagcggtgcgtgattatcgccatacccttggcattctaccggtttacaaacgtgtcgatacctgtgcggcagagtttgcttctgatacagcttatctctattctacttacgaagaagagtgcgaagcgaacccatctgatcgtaaaaaagtgatgattttaggcggtggtccgaaccgtatcggacaagggattgagttcgattactgctgtgttcacgcatctcttgccttgcatgaagctggctatgaaaccattatggtgaactgcaaccctgaaaccgtttcgacggattttgatacatctgaccgcttgtatttcgagccattaacgctggaagatgtgttagaagtggtgcgtgtagaacagccgtggggcgtgattgttcactatggcggtcaaacgccgttaaaactagcgaatgctttacacgagaatggtgtaaacattatcggcacgccagcagacagcattgatgcggcggaagaccgtgaacgtttccaaaaaatcctgcacgatttgaacctaaaacaacctgctaaccgcacagctcgtaatgcacaagaagcagtagcgttggcaaatgaagtaggttatccgttggtagttcgcccatcttatgtacttggcggacgtgcaatgcaaatcgtctataacgatgaagaattgaacaaatatatgcgtgaagcggtgtctgtgtctaacgacagcccgatcttacttgaccacttcttgaacaatgcgattgaagtcgatgtggactgtatctgtgacggagaaaacgtagtgatcggcggtattatgcaacacgttgaacaagcaggtatccacagtggcgactcggcgtgttctctgcctgcttactcgttaagcggtgagatcctcgatgaaattcgcagacagaccaaagaaatggcgtttacccttggggttaaaggcttaatgaacgtacaatttgcggcgcaaaatgatgtggtatatgttcttgaagtaaaccctcgtgccagccgtaccgtgccgtttgtgagtaaagcgacaggtcagccgttagctaaaatcgctgcacgagtaatggcaggggaaagccttgcagaactcaatgctctggaagaggtaattccacaaaaatacttcgttaaagaagcggtgttcccattcatcaaattcccaggggtagatacaattttaggccctgaaatgcgttcgacaggggaagtaatgggcgtgggcgaaacctttgccgaagccttctttaaagcacaattaggcgctggggaacgtattccaagaacaggaaaagtgttcttatcggtggataacaacgacaaaccacgcttgttagatgtggcaaaacgtttacaagagcaaggttatggcttatgtgcaacactcagtacagcgaaattcttgcgtgaaaacggcgtggcagctcaaatcgtcaataaagtgcgagaaggcagaccgcatatcgttgatgcgattaaaaacggagaaattgcgatggtgatcaacaccgtaaacggtgaaccagaagtgattgccgacagccactcaatccgccgtaccgcactgcaacaacatgtgcctgtctataccacgattgcaggagccgatgcgatttcctatgccgttgaacatattaacgagtttggggtgtattcggtgcaggagttgcatagtaactagattataaaaagaagagcttgaatatactttacaaaactaatgttattcaagctctttactaatctatttagacagattattaatatggatattaggcatagtacacaattttaataaataataccccaatactgcggagatacctgaaccgattaagattcctaaacgagcaagagagataaattgaccgtcagcttcatcttcaccaaaagcaagtcctgccaagaacattgacattgtaaagccaataccacaaaggatagaaacagcgaagatttgtttaaaatttatcccttctgataactgtgcgatacccaatttcacggcaaggaagctaaagctaaatacgcctaaggttttacctactaataaacctaacgcaacccccattgtaagcggtgagaataatgtgcttaagctcattcctgctaaagatacgccagcgtttgagaaagcaaatagcggtaaaatcacaaacgaacaccacggtgcaagaatatgttcaaaatgagccaatggttcttccccatttttaccttttaatggaacgcagaagccaataattacccccgctaatgtggcgtgaacccctgattttaatactgaagcccataaaattaatccaacgaccatataagcacaaattgccgtaactcgcatacgattcattatgattaaagcagtaattgctatgactgctgaaatcagggctgtggtacttaattcgtgagagaaaaagatggcaattacgacaattgcccccaagtcatcaataatcgctaatgcgagtaggaaaattttcaaagcaaatggcactcgtttgccgagtaatcctaaaactccaagtgcaaatgcaatgtctgttgccatcggaatcgcccaaccttgctgaaattctggcgaatcactattaatcaatgtgaaaacaagagctggtacaatcattccccctaatgcaccaatagcggggaaaattgcacgttggtagctagaaattgctccaaccatcatttcacgcttcacttctagccctataaggacaaaaaacactgccataaagccgtcgtttacccacattaacaacggtttatgaatactgaataagccaatctggatactgacaggcatacttaaaaaatcaaagtagaggtctttcaagggcgtatttgcaaacagcattgctaacattgcaaaagcaagcaataaaataccgcttgcagactctagttgtaaaaattttcggatatgctggatcattctgttaacctcttgttatgtaaaattcgtcaatctttcttaaatcttttttcttttaacaaaatcagcgtgtaagatcaaggcgaagcgggcagatactgcagaaaatttgtaaaatttgtttgatcaacttcacgaaaagtagcaataaaagatttgaatttatgtttggggaaatttctagattagccttgatctttttggtatttatcgctagaattgcaactcttttttatgatcctcgtttggcttatagtcaatttttaatttttaggtagatagcaaatgaaacgtacatttcaaccatctgtattaaaacgcgctcgtactcacggtttccgtgctcgtatggcaactaaaaacggtcgtcaagtattagcacgtcgtcgtgctaaaggtcgtaaaagcttatctgcataatggcagataagtcagccaaaacactcagtgtgaataagctaactttttctcgggagctacgtttgttagctcccgttcaatttaaatcggtttttgaactgcctctccgtgctagcacgcctcaattaacccttttatctcgccaaaacgatattgaacacgctcgaattggtcttactgttgctaaaaagcatctaaaaagagcccacgaccgcaatcgtatcaaacgcattgtgcgagaaagtttccgcttgaaacaacatcaacttcctgcttacgattttgtctttgtggcaaaaggcggaattggtaaactcagcaaccaagaactatttgaaaccttggataaactatggcaacgccacattcgcctcgctcagaaagcacaacaggaacaacatcaaaactaagccctttggcttatgtaatgctcgcctttgtgcatttttaccgctatgtcattagcccattaattggaccacgctgtcgtttttatcccacctgttctacttatgccttagaagcaattaaaattcacggtgccataaaaggtggctggcttgctctaaaacgtattctacgttgcaatccattgagcgaaggaggcgaagatcctgttccaccgaagtgtaattgcggtacaaaacataaataatattgtaggttgggcagtaatgctcaacttaatctatcttgcccaataccaacttacccgcaaaacgttgcgttaattcatgctgaaacagttccacttgtgtggggttaattgctaagattaattccactttatcactaaattgttgctccaccagctcaatatcccgctctacaatcaaatgttgaatcgtattaaattgctcatattcacactgcaagcggtaagatttgcgtaaaactttgcgaattttttcgacttgcaatagcccttgttgtacaccattgccataggctttaacgagtccgcctgtgccgagcaaaattccaccgtaataacgcactaccactgcactgatttcccccaagcctgaacctagcaagtaattaagcattggtttaccagctgtccctggaggttcgccatcatcagaaaagccatattgctgtgaatcattcggctgccctgcgaccgttgcccagcaatgatgtcgagcatgcggatgtaaagctcgtatttcagcccaaaaggctttggcttgttccattccttctgtatggcgaatgtaggtaataaaacgactttttttgatctcttcttcaaagatcacttctgctttggggataaaaaattccatattctcaactggttacttcatagagttctatcatactttaatgatgagatttgataaatctctttcaaattgttaaaaaaatgtgaaatcattcaagtttttaagagaaaacgtttgcataacagaaaaaagtcgagtatatcttatatcgttttcctatttgagttataggtcaaacgcaacatcttacttttcccaatcctgaatttttagaggaaatagacatgaaaaacttttttaaattatcgttagttgcaagtttagcaatgggttctatggcagctcacgcagaggacaaattcgtcactatcggtactggtggtcaaacaggcgtttactatgtagtgggtcaatcaatctgccaattagtaaaccgtgacatagcaaaaacgaatgtgaaatgtaatgctccatctacaggagcatctgttgcaaacttgaatgcgattgccgataaacagatggaaatgggtattgctcaatcagactggcaatatcatgcttacaatggctcaagctcatttaaaggcaagaaaaacgacaaattacgtgcggtgttctctattcaccctgaaccattcactgtaatggctcgtaccgatgcaaaaattgctaacttcgatgatttaaaaggtaaacgtgtgaatgtgggcgacccaggttcaggtacacgtgcgacaatgaacgttattttggctgcaaaaggctggacagataaagagttcaaagtggcttctgaattaaaaccggcagaaatggcatcagtgatgtgtgataacaacttagatgcaattacttataacgtaggtcacccaaatggtgcgttaaaagaagctgctgcatcttgtgatgcacacttagtgccggtaacaggtgaagcgattgataaattagtggcagatcacccttactatgcgaaagcgacgattccgggcggtttatataaaggtacagataacccagtagatactttcggtgtgtatgcaacacttgtaacttctgcggatgtggatgctgaccgtgtttataccgtggtgaaagccgtatttgataacttcgatcgtttcaaacgtttacaccctgcgtttgaaaacctaaaagaagaagagatgatcaaaaatgcgctttctgcaccattacacgaaggtgcaatccgttactataaagagcgtggctggatgtaattcatccgtttcttaatatgaaggcaggagtaaatcgcttcctgccttttgtcgttttcatcaagcggtcagatttggctgattttttgcaaatttttggttaaatctaaccgcttatcttgggttttctcggaggagtttatgtctgctcaatccaaaactgtggattacgatgacctgcaagatctcgtcgcctcaaatgactcaggcggtcgtaacccgacaggttttagtaaaaaattaattgttgttacagcgattttatggtcgctattccaaatttattacacttcgccgtttccgttttggctgcaagaagtggtgagagattggggctggaatctgaacgtggtggtagatgataccaaagcacgttctattcaccttgcctttgcgatgtttctcgctttcttatctttccctgcatttgcaacatcaccaaaacatcgcattccttaccaagattggttatttgcaaccctcggggcattccttgcggcatactatattttcttttatgaagggctagttacccgctttggtgcaccgaatacgcaagatattattgcaggctgtttaggcattttattattgttagaggcttgccgtcgtagtttgggtttgccgttagtgattattgcgactgtatttttgctttacaactattttggacaatttttaccgagcagttctatcatcagtcaccgttctggttcattatctcaaatcattaaccaacaatggattacaacggaaggggtgtttggtgtcgccctaggtgtttcaaccaaatatgtattcttattcgtgttattcggagctttattggataaagcgggtgcaggtaactattttatcaaaacagcatttgcttatttaggtcactttagcggtggtccgggtaaagcagcggtagtttcttctgcgttaacgggcttggtttcaggttcatctattgccaacgtggttaccacaggtaccttcaccattccgatgatgaaacgtgtcggtttgagctcggaaaaagcaggggcgattgaagttgcttcatcagtgaacggacaaattatgccgccggtcatgggggcagcggcgttcttgatgattgaatacgtcaatatgccgtatagccaattgattgtgcatgcgttcttacctgcattaatttcttatattgctttggtgtatatcgttcaccttgaagcgcaaaaaatgggcttaaaaggattggatcgtgtcgaacctgtgagcccaattttaatcactttgcttaaagtcgtaagctatattttagtgacacttggcttggcaatcgcggtgcattatggcttaggctggattaaaaatgttacacctgattttgccttcttgattgtgtgtattctattggcggcagtctatatcaaattgattcaccgagtttcacaattccctgatttagaagctgatgatccaaattcaccggtcgtatcattaccacgtcgcaaaccaactgtgaatgcaggcttacatttcttattacctgttgtagtattaatgtggtgtttaatgattgaacaattctctccagggttatccgctttctggggaactgttgcacttgcagtgattttagtcacacaacgcccattattaagtttcttccgtaatgatgcgggtaacaaagttgcgctatttaaacaaggcattcaagagttagtggacggtttggagtcgggtgcaagaaatatgattggtatcggtattgcaacagcaaccgcaggtatcattgtaggtgcggtatcgctcactggctttggcgtacagctttcaggcattattgagatactctcaatgggcaatatcttattaatgctgattttggttgcgctctttagcttaattttaggcatgggcttaccgaccacggcaaactatatcgtggtatcttcattaatggcattggtgattgtcgaagtcggtaaacaaaacggcttaatcgtgccattgattgccgtccatttattcgtgttctattttgggattatggcggacgtaacgccaccggttggtttagcctcttttgcagcggctgctatttcaggcggtagcccgattaaaactggggtacaagcattctactacagcttaagaacagcgattttaccgttcctatttatcttcaataccgatttactcttaattgatgttggttgggcgaaagggattctcgtctttatcagtgcaaccactgggattctgctctttacagcagcaacgatgaactactttcttaccaaaaataagttatgggaaacattcgtattgatcttcgctgcctttattttgttccgcccaggcttctttatggaacacatttcaccgacttcacgccatattgagcctgctcaaatggttcaggagttaggtaaagtgccagcaggacaaaatctcacattgaaaatcgcaggagtaaacccttatggcaaaccgattgaattctactcacagcttacagtgcctgaaggtgcaactggcgaagagcgtatcaaagcaatgggattaaccttgttggataccggagagaaaattgaaatcaacggcgaaatgtcaccgaagatcttaattgataatgttgaaattgattcaccggccgctaaagcaggtttaaactgggatcaaaccattcttgatgtagcgttaccacaaaactcgcttccaaaagaattaatgtttattccggctttcctattagcgatttttgtcggttggaatcagcgccgtcgcatgaaaaaataaggacaaattatgtataacaaacttctccttgcgatcgacttaaacgatctcaatagtgctaaatatgtggttgatacggcattaaaactcacagggaacaattccgatgcggtgtatcgggttgtgaccattatcgaacccattgacgacagctttatttctgcttttctaccaaagaacttcgacaagtctgtgatagcagaagcgaataaagccttacatgcctttactcaagccaacttcccagagggctcaaaggttcaacatattgtggctcacggcaccatctacgaagagatcaaccgcattgccgaagaaaaatccgttgatctgatcgtgatgttggcaagcagtaaacctaatgcaaaaggactgagctcaaatacggtaaaagtcgctcgaaatagcgacaaaccaattttagttctgcgttaggcaatcaatacaagcggtaggattttgaagtatttttgcaatttgcaaaatatttgcgaaatcccaccgcttttgtcattaagaaaatcttattttttcgatctgcgtcgaaaaatgaaaaatatcaacttttcttcttataccagctttctataatgccttttcacttatctcaagggcagatttatgttacatctagaaagctatcaaaattggttaaaatcacttaaatatcacattcaccactcccagcaacgagctatgcttgcggtgaacagcgaaatggttttgctttattggaaaatcggacaagaaattttacagcggcaacaaagcgaagggtggggagcaaaagtcatcgatcaactttcacgagatctcactgcagaatttccagatatgaaaggcttttccagccgaaacctgaaatatatgcgaaaatttgctcaagaatggactgaatttgaaattgtgcaacaggctgttgcacaattaccttggtcccataatgttattttgttagacaaactaaataatgaacaagaacgcctttggtatgctcgcaaagcaattgaaaatggctggtctagaaatatgctggtacatcaaattgaaggtcagctattttaccgtcagggtatagccatcacgaattttgacaaaaccctgccagatacacagtctgatctcgcaaggcaagcctttaaagatccctatattttcgactttttaaatttaacggaacaacgccacgaacgtgaattagaacaggctttaaccaaacatattacacaatttctattagagcttggtgctggatttagttttgtcggaagccaagtcaagttaaatgttgggggtgatgatttctatattgatttactgttttatcacttaaaattacgctgttatgttgttattgagctgaaaacttgcgatttcaaacccgagcatatcggacaacttaatttctatttgactgtcgtcgataaccaactaaaaacagagatagatacgccgacgattggactattgttgtgtaaaaatcgcaataaagttgttgtggaatatgctttacaaaataatccattacccattggcgttgcagaatatcaacttcagcaactgttggctgaatttgatatggaataaaccgatattggtttggtgttaaacaataaaatgaagcggtaggattatgataaaacattgcaaaatgttgtcacaatcctaccgctttatattttgaactatttactattgagcagataatttttcttttaacaggctaatttcatttcttaaactttcaatcacatcatcttttaatttaataatttcatctttatgagcaagcattaaatttaatttttcaacatcatcactacctaaaaatatatttgaacttgcattagtattattatttcctgtactaatagtaatccctttattttccccataagttaataattcataaatatccgcatttaatacacccaaaatttgttctaatctttcaaaattcactcgggtttcaccacgctcaattttagcatatcccttggtggacatacttaatttagtcgccatttcttcttgtgaaagttgatgatcttctcgaaataaacggattttatcattgatattcatagccttgccttatcagtactttttagggtggtaatgtgaatgttttgtggattgtagcataagtgaacggtttgtagaatagtgaacattatgcgatcgtttattgagattgttatatgtcattcattacacaactaggaaaagtattatttggttcaaatattaaaccaaacacaggggatcagcatacagataaagtttctcatcaagtttacgaacaaggtgtaatactactttcacaaggaaactatcaagaagctcttaatcattttaaaaaagcggcttcttttggacatatctctgctaaatataatttggctcttatgctatttaatggattgggagactatcctgacttcgaactagcttgtaaattgttccaagaagccaaaaatgcaggacatactcgctgtgatgagtttttaagttttatgcaggctgttgatgagattttttccgaagagctgttatttgaagaactcgtgtgtcatcctatttttattataaatggtgaatttgctataaaaaaattgggagcaaatttagagctccaatctggggagattatttattttatttctcgttattttttatcaagattaaaaattaatgatgtctatataaaaatatttttaggatataacagagaatttctagatgaagatgttttcgatttaggtaatttgattgaagaagaattttatgatccaaatcttaacatgtcttgggttatggagtttttgggaggtcaagtagatgagataacctattttgttgattctgtgatttggaaaaatgtaaaagataattttgattatgaagattatgaactacataatataaagtttaagatagtaagagaagttatcaagcaaatttttccttataatataattgaggtgtaaaatggggtttttagatagtttttttaaaaaaacagataaacagttaaatacagctactgatgctaatcagaatatagctcaattactgaataaagttgaaaagctagaagggaaaattgaacagcttcaagctgagaaactaaattatgagttaaaaattaatgggtttgactggaaaataacacaatatgaaaatcaagtaaaagatctacaaagtgagaatacaagcttacaaaaaaagcttattgaaaaagataatgtaataaatacattaaatctaaaaatttctgaaatagaaagttcttgtagagagattggagaatgtgctcaggagggatcaccagagataatagatgtagcccctttagaatcggaaaaaaatctttctttaaaagatcataatttatctgataactcaagtaataaaattgatggggttataatagataaaagtaataagccattcttggatgctctagatattattgaaaactcaaatgaaagtttattcctaactggtaaagcaggtacaggtaaaacaacctttttaaaatatttaacttctaaattgaagaaaaaatttattgtgctagctccaacaggtgttgctgcagttaatgcaggtggagttaccttacattctttctttcgattaagttttagcccatatttacctgatgattcaagattaataagagataatttaaaacttgataaaaatagatttgatattattaaaaatgtagagactattattattgatgaaatatcaatggttcgatgtgataccattgatgctatttctcagattctaaaaaccttaagacacaataataaaccatttggtggcgtgcaaatggtattcatcggtgatttatttcaattatctccaattgctgatgctagattttgggattttctcggtgatttttatgacactgaatttttctttaacgcatttgcatttaaagaaagtaaatttaaatatattgaattagataaaatatatagacaaaatgatcttaaattcattgagttactaaatagagttagagaaaataatattacaaatactgatttacaattacttaattctcgattacaaaacgtaacgaactattccatggatggttatattacattatcaacccatagaaaagatgctgattcactaaacgcaacaaaactagctaaaatcaacaaagaacttgtttcatttaatgctattattcaagggttatttgatgaaaaagacgctccagcggatacattattatcgcttaaagtaggagctcagataatgttaataaaaaataatctgcctgactattataatggtagtatgggaataattgaaagtatagatgaagaacattctataaatgaaaatggcgatgaagctgtagatgatgttatttatattagattattttcaaataatgaggttgtgaaagttactagagctgtttgggaaaatcaaaaatatacttataacagagagaaaaaacgtattgagcctgaagttattggtacatttacacaattccctgttaagttagcttgggcaattacaattcataaaagtcaaggtttgactttcgataaagcaattattgatgctggcaaggcatttactcacggacaaacttatgtggcattaagccgttgtcgttccctagaaggaatgttactaaaaactagaatagatcctaaagcaattattgttaatactgaggtatctcaatttataaaagaaatgaatggtgaacaaagtaattcatataatttttataactctgatgatgagataccattctgaattacatataacttgaatttgtcaaaataagcaagcaaataataggaaagagtcttttaaaataaaaggataattaaaatgtttaaaatgatcggtaatttattctctgttactagtaaggcgattggaactactatagatgttactaattcggcactgaatgaggtaaataaaggcttagatagctttaattctaatttgagaaaacatacggaaaaaatggagttattaagagatttatcaaagaaagtatatgaaaataaaatatcttatgctgaatctcttagaattgtaaaatctcaactaggtgaaatagcatatcctgattacgaagagaaattagatctttatagagatttagagtatgtagataaatcctatgatatatttggaatggggtctacacataaagtaatagcaaaagaacttgttaaaaaagagttaattaataagtatggtcggataaatgaaacgtattttgaatataggttaagagatcgtagagaagatattattagactacttttgaatggaagtcaaaaatcctattttgattttgaaagaatgaatgactctgagttgatagagctataccataaagaaatagagctataccataaagaaatagataaggttaataaatattttgaaatattaaagtagctcctttaaattaaagtaggaattaaaaaggcatagcaaaaaatcactgctatgcctaaattttgtaaataatttgctcaatcccaccgcttacccttcaaagggattaaacaacttcacacctgtgcgagcaaaatcagcggaatttcgagtgactagcgttaagttatgttgaattgcactggcggcaatccacgcatcattttcgggagcgtgatcagggatatgtaatttggcacagatttgggcggttttttcgtctattttcaggattttgccgtgaaatgtcggtaaaaccacactatcaagccaagttcgtaaaacagccccttggcgaaaatccttatgttctttcgccaaaataccacgctcaatttccatcaagacaacagcgttgataaaaatatcttgtgctgagatcgttgaaaaccacgcaacaaaattgggattggctttaccttgtttgattttacgaacttcgctcactacatttgtatcaagtaaatacattttcactcctagtcttccaaatctacaagacgacgctgtccacgactgcgtgattgtaattcaagctcaatgtcttcattatcaacaggtaataaagcttccaaagcggaacggaacggcttcgcttgctgtactttttcatattcccgatatgtcattaacacaaatgcaggtgtaccacgattggtaatgatcacaggttctagcatagcggctttttgagcttggctagaatgttgattaaattcacggctggtcataatcggcattttgcatcccctcttaatgtagataagtagatacaatattactgcgattgacgaaatagggcaagcgtaaaaagtggaatatgatttataccttttaattactcttattttgttccagcgttcaaaccatttttacgttacaataatgtcattcaacaaaatgacttttgattatcaacaatgaaaaaactcaacattatttttgcaggcacgcctgattttgccgcaacccatttacaagccttgttaaattcggaacataacgttattgccgtttatacacagccagacaaacctgctgggcgtgggaaaaagctacaagccagccctgtcaaacagttggcggaagcacatcatattcctgtgtatcagccgaaatcgttacgcaaagaagaggctcaagctgagttacaggcgttaaacgctgatgtgatggttgtggtggcgtatggcttaattctgccagaagcggtgttaaaagcaccgaaatatggttgcttaaatgttcacggttcgttgttaccacgttggcgtggggctgcacctattcagcgttccatttgggctggcgatacggaaacgggcgtgaccattatgcagatggatattggcttagatacgggcgatatgttgcataaggtgacaacgccgattttagcgacggaaacgtcagcaagtctttatgccaaacttgccgagcttgcaccacccgcattgcttgaagtattaaacggtttaacaagcggtcagtttaagcctgaaaaacagcaagacgagcaagcgaactacgctgaaaaattgacaaaagaagaagcaaaattagattggaatatgaccgcttgtcagcttgagcgtaatatccgtgcctttaatcctgccccgatggcatatttaaccttgatggtgaatgaagtggaagagcggataaaagtgtatcaagcggaagtgctgccacatcaagagaaaacggtcggcacggtgttggcggtggataaaaacggtatccaaattgctactcaacaaggggtgttaaacattacccaacttcagccagcaggcaaaaaaccgatgtccgtacaagattttttaaacggacggggggattggtttaaggtaggaagcgttctctaatgaaaaaacattccactcgtgccgttacggcacagattattttacaggtgttggatcagggcaaatccctttcaaccttgatccccgaagcacaatcgcaacttgatagtaaagatttagcgtgggtacaggaaacgacctttggtatttgccgtgtgttgcctcgtttagaagcgattatcaaattattggtagaaaaaccgctgaaaaacaaaactcgcttggtacattgtttgcttttggtgggcttgtatcagctactttatatgcgagtaccgccccacgccgcagtagatgaagtggttaatgccacaaaagcgttaaagttggatagctttcgagccttgactaacggggtgcttcgccgttttctgcgtgagcaagaagcaattttggcgaaagtggataaacattggcaaacactacaccctgaatggttggtgaataagctgaaacaagcctatccgaattggcgagagattgttgatgcgaataaccaaaaaccgccgatgtggattagggttaatgctcaacggactaaccgagcggactatgtggcattgttgggtgatcttgcaaaaaatcacaaagaagcgaccgcttgcgtgcctgattgtgccgttttattagataaagcggtgtcggtcagccagcttcctcactttgaacaaggttgggtgacagtgcaagatgcacacgcacaatggtctgccgaattacttgacgcacaaaatggcgagttgattttagatgcctgtgcggcaccggggggcaagacaacccatattttagaaaaagcaccgcaagcaaaagtaattgcattagatattgaagaagcccgtttagttcgggttaaagaaaatttagctcgtttaaaccaaacggcaacggtgatttgcggtgatgccagccagcctgaacagtggcttacaagcggtgagatgttcgataaaattttacttgatgccccttgttctgcaacgggggtaatccgtcgtcacccagatattaaatggctacgcaaagaagaagatattgctgagttggcagaattgcagggaaaaattctcaaagcactttgggcaaggctcaagccaaacggtgtgttgttgtatgctacttgttctgtgttaccagaagaaaacagtcagcaaattcagcactttttagctcaaaccccagaggctaaattagtcgaaatcaatgtgggtggcgagcaatgtttaatgaagcaattctttcctaaacaagatgggggagatggatttttctatgcgaagttagtgaaacaggcgtaaaacggtgagtaggcaatgaaaatcatcattttaggtgcagggcaagttggctcaacactggcagaaaatttagcgaataatgataatgacatcaccattattgatgatgatcagcaacgtttagctcaattgcaagataagcacgatttacaagttattcgtggtaatggggcttcacctcgtattttacgagaggcgggagctagtgatgcggatttattggttgcggtaacaaataatgatgaaagcaatatgattgcttgtcagattgcatatacgctctttaatgtaccaactaaaattgcccgtattcgtaattcggattatgtccgtgagcgtgataccttatttaataacgccgtattgcctatcgatcatatcattgcacctgaattattagttacacaggatattttacgccttattgattacccaggtaccttgcagattgcccactttgccgatgaattaattagtttggtgagtttaaaggcgtattatggcggtccgttagttggttatcctatttcggcattaggcgatcatttacctcatgttgaagcccgaattgtgtcaatcttccgtcaagaaaaagcctttattcctcaaggttcaacgattatcgaagctggtgatgaaatcttttttgtctgtgctacgcaacatatcaaagcggtaatggcagaattacaaaggctggaaaaaccacataagcgagtaatgattgtggggggcggaagcattggaattgcacttgctaaagcacttgaggatcgttgcagtgttaaactgattgaacgaaaccaagaaagagccgaaaaacttgcttctaagctgtctaagacgttggtgttatgtggcgatgcgtccgatcaagagctgttatttgaagaacatattgagaacattgatttattccttgctttgacgagcgatgatgaggcgaacattatgtcgtctttgttagcaaaacggttaggagcaaaaaaagcgatcgttttagtgcaacgaatggcatacctacaccttattcaaggcggaactattgatattgctctttcgccacaacaagcgacaatttccgctttgtcaagccacgtccgcaaaggcgatattgttcatgtggcttcgtttaaacaaggtttaatggaaggcattgaagtgattgctcacggcgataaagaaagctcaaaagtggttggtcgcaaaatcagcgagctaaaactgccacagggagcaattgtgggggcgattatgcgaaatcgtgaagtgctgattgcccataaatctacggtgattgaggaaaacgatcacattattctgtttgtgaatgataagaaacagtctgccgaagtggaaaaactcttccagttgagtgcgtttttcttgtaataagtaaggagtaatagaactagtattaacttacctatattgtatctaatacaaaatctatttcgcctctctttctagctgagatgtaagtcacaaataacgggcaaatcttcaaaataaaatagttctatgctcgcttccattttatatgctatgttcgtgtaaataacaatggataaaaataattttatacgtcatataaactccactacatatgtgtttaacaacacattctacttatcttatcaatctaaaattaaaataagtactgattttgaatgaaagagtaaatcaaatttaattattggatttctcttttaaccaccattacttagtttttatattgctaagtttgaattattagacttgatttatatcctgtcattattactatttaagaaagttaaattatcaaagtccgaatattcaagtagccaaagtttattttcggtaatttctgacgaaataaataaaaagcatcatattcggaaacgctaaaggaaaactacgcaaagcgtaaaatccgtaagataaaatggtcacaaggagagattactggtaggtacaaaatactaattgtgcataaccataatgagtaaagaaaacgataatattattctgtttataaatgataaaaagcaatctacagaaagagagggaacctcctgtcaaagatggttttatggttctacaaacggatatatcaagatatcttttttcaaaaaatgtgattgtgatcacagaattactttataagcctttaatataatatagacgaaacaggatatttaatagtatatctgatacataaatgcaaccgctgaacgatatattattaataactatttcaatcaactatttataatatattcattacatcttaaaggagaaaactatgattcttggctgcccaaaagaagtgaaagtccaagagtatcgtgttggcttaacccctgcaaatgtgcaatcttatgttgaagcagggcatactgtttatattgaacacggtgcaggtgctgaaattggtttccctgatgaagcgtatcaagccgcaggtgcaactttgactgacaaagcaacactctttgcaaaaagtgatatgatcatcaaagtgaaagagccgattgaatgtgaatatcactacttccgcgaaaatcaaatcctttatacctacctacacttagccgcagacaaaccgcttaccgaaatgttgcttgaacgcaaaattcaatctgtggcgtatgaaaccatcaaaacccctgcaggtttaccttgcttagcaccgatgagtgccattgcaggacgtttggcgaccttagaagctgcgaaatatatccaaaaaaccttcggtggtgcaggtgtgttactcagcggtacagcgggtacaccaaaagcgaaagtggtgattttaggtggtggtgttgtaggcttaaatgcggctcaaattgcgatgggtatcggggctgatgtcactatcctagatattaacgctgctcgtcttgcttatatcgatcaaatctttgatatgcgtatcaaaacactcaccagctctcgtggcaatattttaagcctattaccagaagctgacgtggtgatcggtgcggtactaattccaggtgctaaagctccgcacttactacgtcgtgaagatctcaaattgatgaaaaaaggtgcagtattagtggacgtagcaattgaccaaggcggttgctttgaaacttctcacccaaccacacacaatgaacctatctatgaagttgatggcgtaatccactactgtgtggcaaatatgccaggctgtgtggctcgtacttcaaccttaggtttaaccgactcaaccttagaatttggcttgaaactcgcagcactcggtgtgaaagaagcgtgcttgtctgatccagctttattacaaggtttgaatacttacaacggtaaatgtactttcaaaggtgtgagtgatgcctttggtattgcttataccgatccaaaagaagcattaaattaggggctgtcctagataacgactaaaagctctattttaggttaaaataaccaaatgagaaaaagtcgcctaagtcagcataaacaaaataaactcattgagctgtttgtggcaggtgtcactgctcgaacaacagctgagttggtaaatgtaaataaaacgacagcagcctattacttctatcgtctgcgattgcttatctatcaaaacagcccacatatggagatgtttgaaggtgaaattgaagccgatgaaagctattttggcggcactcgcaaaggtaaacgaggtcgtggagctgtgggtaaaaccgctgtattcgggcttttaaagtgtgatggtaaggtgtataccgtcgttgtaccgaatattcaatctgcggcacttttaccgattattcgagaaaaggtgaagcctgacagcattgtttacaccgatttttatcgaagctatgatgttcttgatgtgagtgagtttaatcattttcgtatcaatcacagtactcatttcgcagaaaaacaaaatcatgtaaacggaattgagaatttttggaactaagctaaacatcatttacgcaagtttaacggtattcccaaagcacattttgagttgtatttgaaggaatgcgaatggcgttttaatcacggtaacttaaaatctcaaatttccattttaaaacaattagttaatggcagcttaagttagttatctaggacagcctcatcttttatatatctactaaaacaaaaaaccgcaggctatctctaacctgcggtttcttctctttaataaaaccccgacgatgctctactctcacatggggaatccccacactaccatcgacgttacagcttttcacttctgagttcggtatggaatcaggtgggacaactgcactattgtcgtcgggaaaatcttttgatgattctctctatcttcttttttctgttctttaagggcaaatataatttgcccctacactattcttattcgaaacaagctgttctgagtctctttgttttattttgtttagttagtttgttgcttttattcagctctctaactctctcacgtctacttcaaaaacgcttgaggttgtatagttaagcctctcgggcaattagtatctgttagctcaacggctcacaccgcttacacaccagacctatctacgtcgtagtctccaacaacccttacacacttattgtgtgggagaactcatcttaaggcgagtttcgtgcttagatgctttcagcacttatctcttccgcatttagctacccagcagtgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttactctttgggaggagaccgccccagtcaaactacccaccagacactgtccgagaccgcgtttcgcaatcttcgttagaacatcaaacgttaaagggtggtatttcaaggacgcctccacaatcactggcgtgactgcttcttaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgattacaccatcaattaaccttccagcaccgggcaggcatcacaccctatacgtccactttcgtgtttgcagagtgctgtgtttttaataaacagttgcagccagctggtatcttcgactggttcagccttcggaggtatactcctacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttccggcgaacgagtttttcactcgttttatcgttacttatgtcagcattcgcacttgtgatacgtccagcaaacctctcgattcaccttcatccgcttacacaacgctcccctacccaacagacgtatcactaataatcctctcttcgattactttccgactcaacgttcgggttgcttgaccaacatctctttccgtttcacttcattcgatgttgttaatcgtaaggcgtattagtgatacgcctgatgccgcagcttcggtgctatattttagccccgttacatcttccgcgcaggccgactcgactagtgagctattacgctttctttaaatgatggctgcttctaagccaacatcctagctgtctaagccttcccacttcgtttcccacttaatatagactttgggaccttagctggcggtctgggttgtttccctctccacgatggacgttagcacccaccgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactatccgcccagttaagactcggtttcccttcggctcccttattcagttaacctcgctacaaaatataagtcgctgacccattatacaaaaggtacgcagtcaccccaaagggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagcttagtaccacaacaaaaacttcgaatacggggctatcaccctgtgtcgcttggcttcccagccaattcttctgtctttgctgctatcactcactggctctttcgctttcgctcgccgctacttacaaaatctcggttgatttcttttcctcggggtacttagatgtttcagttctcccggtttgcctttcattactatggattcataatgaaatgatggattcttcatccatcgggtttccccattcggatatcttggattaaacgcttcttatcaactcatccaagcttttcgcagattagcacgtccttcttcgcctctgattgcctaggcatccaccgtgtacgcttagtcacttaactatacaacctcaaacatttttatctaaaagaaaaaacatttaagactgatattaactactaaacacttaaccgcttttgttcagttaagattttcttactactcagactttcttgtttcagggcaaatatgatttgcccctacagaaaatctctcagttttcagcttgtttccatatttttaaagaacaattcgataattacttatctttcgacaaaaaaatcatctttaaatggcgtccccacggggattcgaaccccggttaccgccgtgaaagggcgatgtcctaggcctctagacgatggggacatcatttaaagatgctttccttcatgctgtcaatttgcaaattttatcgcaaatctgaccgcttgtgtctgttttcttgctctattccttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcaccctctgtatgcaccattgtagcacgtgtgtagccctactcgtaagggccatgatgacttgacgtcatccccaccttcctccagtttatcactggcagtctcctttgagttcccgaccgaatcgctggcaacaaaggataagggttgcgctcgttgcgggacttaacccaacatttcacaacacgagctgacgacagccatgcagcacctgtctctaagttcccgaaggcataaactcatctctgagttcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagcaacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtaatgttctattaaaacaccacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaactggccttgcggtcccagtctttcatctcccgatactacgcggtattagctacagtttcccgtagttatccccctccataagccagattcccaagcattactcacccgtccgccactcgtcagcaaagaagcaagcttcttcctgctaccgttcgacttgcatgtgttaagcctgccgccagcgttcaatctgagccatgatcaaactcttcaatttaaaaagtttaatcgctcaatatgtactgactataaaaaatcacgactgaatttattcaatcattatgaatttcaagttaagcacctatcaagacttcaaaattaaaaaatatttttaaacaaagtcaatcaacaagtgcccacacagattgtctgataaattgttaaagagcaaaaaaagaacgacgcactgtcaaatttaactactcacaacagcgcgtcgttgtgtggtgcgaattatagagaaatcctaaaccaacgcaagtactttttgcaaaaaatttgaaaaaaatgatcgcttgtttaaaataagctcataatgtttatttcaaaaacaataaatgcctatatcttactatattcttatcaaacatcatctgaatatatcaatcatagaaatcttactaatcccctacacactatattcaatcaaaaaatctattgcttttcattaatttttctaatatgtttacaccacttaccgatttaaaaagaaataactaggaagtgatttgaatgacaaaactttataacagctcatttgagcgtgagaattgtgggtttggcttgatagccaatatagatggggtgcagagccacaaggtggttcgtaatggtattttgggtttatctcgtatgcagcaccgtggggcgattttggcagacggcaaaacgggggacggttgtggtctttctttgcaaatgcctgagagcttttttcgtgcggttgcggcggaaagcggttttactttggcaaaaattttcggtgttggacagatttttttgcctggtgatgaagccttagtcaaagagtatattgagattatcaatgaagaattaacccaagaaaccttgggtattcctgcgtggcgtgatgtgccgaccaatccttctgtattagggggaattgctcttgcggatatgccaacgattaagcaggtgtttgtgaatgcacctagcggttggcgtgtgcaggatttgcaacgccgtttgtttgtggctcgtcgccgtattgagaagcgtatcaatcaccctgacttctatatttgtagtttttctaatcaaacgattgtctataaaggcttgtgtatgccgaaagatttgccaaagttctatttggatttggcggatttgcgtatgcagacggcaatttgtttgtttcatcaacgtttttcaaccaatacccaacctcgttggaagttggctcaacccttccgttatcttgcccataatggtgaaatcaatacaatttcgggcaaccgtgcttgggcaagagctagggcgtataagtatcgtacgccgttaattcctgatttgcagacggcagctccttttgtgaatgaaacagggtcggattctagctcgttggataatatgttggagctgtttgtcagcggtggtatggatttattccgtgccatgcgtttgcttgtcccacctgcgtggcaacaaaatccagatatggacgatgatttgcgtgcgttctacgactttaactccatgcacatggagccgtgggacggccccgctgggatcgttttaaccgatggtcgttatgccgcttgtaatcttgaccgcaatggtttacgccctgctcgttatgtgattacccaagatcgtttgattaccattgcgtccgaagtgggaatttgggactatgcccctgatgaagtggtagaaaaagggcgtgtcggtccagggcagttgttggtgattgataccaaacacggtcgtttggtgaattctgatgagattgacaatgaagtgcgagccagacacccttatcgtgagtggttaaacaaacacgttcaacgtttaattccctttgagcagttgcctgaaaacgaagtgggcgaagcatcgcttgatgagttgcaactgaaagtgtatcaaaagcagttcctttatgataaggaagagctggaaaatgtgattcgcgtactcggtgaaagcgggcaggaagcggtcggttcaatgggtgatgatacgccttttgcggtgttgagcgaacgcccacgcgtgctgtttgactatttccgtcaatacttcgcccaagtcaccaatccaccaattgaccccttgcgtgaagcccatgtgatgagccttgctaccagtatcgggcgtgaaatgagcgtgttttttgaagcagagggaatgtcgcatcgggtgaatttcaaatcgccgattttggtgtattccgatatgcaacagattttgcgtttgcctgaggaacactacaaacacacgatactagatgctacctttaatcctgatgaattgagcttaaaacaggcaatcgaaaatctatgcgagcaggcaaaacaagcggtgcgtgacaaaaccgtgttgctgattgtgtctgaccgcaacatcacggctgaacgccaacctatcccaagtgccctagcagtgggggcgttgcaaacctgtttggtggaagccaacttgcgttgtgataccaatattttggtggaaaccgccgaagcacgcaatccacatcattttgcggtgttaatcggcttaggagcaacagcagtttatccctatcttgcctatgaaaccattgccgatatggtgcaaaaaggggcaatcaacaaaccgcttcgtgtggcaatggcaaacttccgcaacgggatcaacaaaggcttatacaagattatgtcgaaaatgggcatttcttgtgtgtcgtcctaccgttgtgccagattgtttgaagtggttggtttaaatagtgaagtcatcaacctttgcttccctggtatcaccagccgtatcgaaggggctagttttgcagatttagagcaacaacagaccgcttgtcgtaaacgtgcatggcgacacagccaagatattgaaatgggcggttatctcaaatacaaaccgcaaggcgaataccacgcttacaaccctgatgtagtgaacaccttgcagacggcagtcaatacgggcgattatgaaaaatacaaagccttccgtgatgtggtaaacaatcgtccgattaccacgatccgcgatatgttgcgtttgaaaaccgaagcaggcaaagcgattgagcttcaccgtgttgaaccagcggaaaacttatacaaacgctttgacagtgcggcaatgtctatcggtgcattaagccccgaagcccatgaagccttagcagtggcaatgaaccgcttgggtggctattccaactcaggtgaaggcggtgaagatccgaaacgttatggtacagaaaaagtatcaaaaatcaaacaagtggcatcgggtcgctttggcgttacccctgcttacttaatgagtgccgaagtgatccaaatcaaagtggcacaaggggcaaaaccaggtgaaggcggtcagttaccaggggataaagttaccccatacatcgctcaacttcgctatgcggtaccgggttcaaccttgatttcaccgccgccacaccacgatatttactcgattgaagacttggcacagttgattttcgacttaaaacaaatcaacccgaaagccttaatctcagtcaaactcgtttccttgccgggtgttggcaccattgccacaggcgtggcaaaagcctatgcggatttaatcaccattgcaggctatgatggtggcacaggtgcaagcccattaaccagcgtgaaatactgcggttcaccgtgggagcttggtttggcagaagcccaacaggctttggtggaaaacaatttgcgtcataaagttcgtttacaagtcgatggcggtttgaaaacaggtttagacattgtaaaagcagcgattttaggggcggaaagtttcggtttcggtacagcacccatggtcgcattaggttgtcgctacttgcgtatctgccacttaaacaactgtgcaacaggcatagcaacacaagacgatactttgcgtaatcagcattaccacggcttacctgaaaaagcgatgaactactttaaattcatcgcccaagatgtgcgtgaaattttagcagaacttggtgtagagaaattaaccgacctaatcggtcgcaccgatttattagaaatcatcaatggcaaaaccgctaaacaacaaggtctagacttggctaaattgctctattcgccaaaagtgccagacggcagtagccgtttctgcacccaagccaaccctgcttttgaccaaggtttgttgaataaagcgattgtggcacaagcccaaaatgcgtttgaaagcggtttatcagcggatttggatttcgacatcagcaatttagatcgctctgtgggagcaaccctttcaggcttggtggctcaacgctatggcaatcgtggcaatccattgcaaaccttcaacatcaacttaaacggcaccgcaggacaaagttttggcgtgtggttagcgggcggtgtgaacctgaacttaacgggtgatgccaacgattatgtgggcaaaggcatggctggcggtcgcattgtgattaaaccgcacaatggcgttgcctttaaaaccgaagaagccgctattgcaggcaacacttgcctttacggtgcaacagggggagaactctttgcatcaggtcgtgcaggtgaacgctttgcggtgcgtaactcaggtgcattagccgtagttgaaggcattggcgacaacggttgtgaatacatgacaggcggtgtcgttaccattctcggcaaaacaggcattaactttggtgcaggcatgacaggcggtttcgcctatgtgttcgatgcagacggcaaatttgccaaccgcattaaccctgaactggttgaaggactaagcatttgcgatttaccaactcaccaagagcatttgcgtggcttaatctctcgccacgttgaacttactctcagtgcgattggcgaacgtatccttgccaactgggacgattatgtcgcacgctttgtcttggtgaaacctaaagcgaatgacattaatgccctactaggacacaaacgccgtgcattagatgagttaggtgtgattgtgcagtaaaaagtgaaaagatgaagatgcaaatttctttcttccatcaaagtgaacgctaaactttttgaagtaatcagcaggtagggacgcactgcgtacgtccgcttaatcgaataagctctattcaatggacacacacagtgcccctaccgctcaaaatcgttcattcatcgaaaaaataggactactctctgctttgtagaagaaagataaagtaaaaggaacacaaaaaatgagccgtgataatgtttaccaatttatagatttaccccgtgttgatccgtcaaaaattccattaaacagtcgtaaaagcgagtttatcgaaatttaccaaatgtttagccaagcacaggcagagtcgcaagccgaccgctgtttagagtgtggcaacccctattgccagcacaaatgcccattacacaataacattcctaactggctacgtttggcacaagaaggacgtatcattgatgctgcagaactggcacacagcaccaacagcttacccgaagtttgcggacgtgtttgcccacaagaccgcttgtgtgaaggttcttgcaccttaaatgccgaatttggtgcggtcaccatcggcaatgtcgaaaaatacatcaccgaaaaagcctttgaaatgggctggcgaccaacagtgaaaaatgttcctaaagccaacaagaaagtggcgattgttggtgcaggtccagcaggattaggttgtgcagacgtgttaatccgcaacggtgttgatgtggtggtgtatgaacgccaacgagaaatcggtggcttgctcacctttggtattccatcattcaagttagaaaaaaatgtgatgagccgtcgccgtgagatgtttagcgagatgggcattgaatttaaactgggcatagaaatcggcaaagacatcagccttgatgatttggttgctcaatatgatgcggttttcttgggcgttggcacctatcaaggcatgaaagccaatattccaaatgagcaggcacaaggcgtttattccgccctgccatttctcatcggcaacacacaacatttgctcggtttagcggcccctgattacgtttcaatggcaggtaaaaaagtggtggtcttaggtggtggcgataccgcaatggactgcgtaagaacatcggtgcgtcaaggtgcagcagaagtcacctgcgtttatcgccgtgacgcagacaatatgccgggtagccgtaaagaatacagcaatgccaaagaagaaggtgtcgagttccaattcaacgctcaacccgtagaaattgaagccgaaccattagccgttgaaaccgaccaatcaggcaaagtaacagggattaaaatcatcaaaacccaactgggcgagcccgatgccaacggtcgccgtcaagccgaaatcatcgaaggcagtgaagaaatcatcgcttgtgatgccgttatcatcgccttcggcttcgccccacacgaaatgccttggcttgcctcaatcggcgtaaccacagacaatcgtggcagaattgcaacgactggcgaactcaaacaacaaactgccaatccaaaagtctttgctggcggcgacatcactcgtggctcagaccttgtggttaccgccatcgccgaaggacgtgatgcggcggagagtatgatggagtatttagatgtatagcaagcggtgagattgtattaaatatttacaagacacattgtattatatagtctgataaagataatttgctctcccgaaatatttctaaaaatatattaatacatagagagagcatttttctttacaattaattcttattaaatgaatctaaacgaataaataattcattttctaaatttaaggtaattaaaacctgttttaatcgagctaacttatcattattactataattagtttccatttggtagttattaggtaaagctactgctactcgtagttcgtctttttttccatctggaacaatacgtaacttttcagccaattgggtttctaaaaatctagtaggttcctcttggaataattgttcaattacaactctataaagctctgtaacattattaacctctaactgaatatcttggaattgtgctgaaatcaatttcctataggttaaatcatttacatccattaaattaatttctgagtcttgctcttcatattcaggttgtttccaaatattaagaaaacgttccgataataaagtaaatcgatcttcccactcattttttccccatttcgatagagaacttaatgagctatttaaccataatcgactatccttgtacaattcacgttttttgataaaacttttattagatagctcagaattatatccagttaaagtcaaattagccaaagtatgtaatttctgttgcataaattcgtattgctgcgaatctaaatcctcataccaatcatcacctgcattttgaggaaaaatatgttcaaggctaatttttttattatttataatggatataaactctttattcttaaagttttctagtctttcaaacaaataggttctatttttagaagcccaattatatatagaacaattttttaatgcctcaatcacctcaacatcattcggaaaacgctgattatttgtacgttttgacaaagatttaacgattgttgctacataattttctgatactactaactcattttcattatatagtgccataaaaattttatttaatgcatttgttgggagtccaacaactagacgtcgaacaataaaagactgtaaccattctaaaatttgaatgaattgctccttattaattttatttaaataactgtaatcatgataaatatttaataaaaaaggatacgcagttttaacctccaataatttaatatattgtaagtgtaatcgaatccctacatcttcctctctttcaggatttattaatataccataatactttgaaaaccgttttaattctaataaatcatcctcctgtacccttggatatttacttttaaaagcttcataaattctagttttatttggaatctttttatttattttagtaagataatcacgaataaagtcagaaactttactttcattatttgtatcatctttagcaaacttctcaattatatcccaatattggaagaatatattttgcttatcactttctaaatccatcaatatataatttctaattaaatctgcctcacttaatgctaaacccgttgaatttaaactctcaaaaatacgttgtggattatccttccctctctctaatgaaacttctacaaacattaatttatccaatccttgtctgactatatcgaagttttctagcgtaatacaagatttaaaatatttaaaattttccaccaatcgtgaaaaatatcctaacccttcactaaaatttcctttataaatatactccatagctgaaacatgattatctgttggcttaagttttaatttatatggtgcagaagaaaacttattaatcagaatagtttcattaatttcgtcagctaagtcattttttccttgagattttgtgagatgatataacaccaaataaattaacataatggtcgttaatctctgttgcccatcaataataatccactccttaatttgtgaacttgtgtaagcaccattattgtgaatataaacaatacttccaataaaatgattagaaacatcacaatcttgccctatactcaaaatatcatttagaagttgctggcattgttcaactttccaatcataattacgttgatatacagggatagtaaactgtacttttgtgctagttaaaaaatcagcaatttttaattcacttgctttcatattcattctcctgacgatatcaatatatccattattgtgtacaaataaataacgctattaataatttttcgggggggagggggtaaatctcaatattctaaaatcctacaccatattttcacaccaaattacctactcgcccagtaaagagtttaaacaaatgtgcttgtattccgaatcgtctgcaatggcaatggataaatctgctacgctgatacctgctgaggcttctccgttcatcagcatataatcatcgtctaaacaatattcccccgccccccttcgtaaccaacccgttacgcctattcgttcgctaaaatacgcaccgtgctaacagatgaatttcttgtggaaatgctggtatatcaaccaatttcacattcaatgcaacaaatcaatacctgcactgcctacgatcaacaaataaggctcttgtgctgcttttgccactttgtcagtattacgaacataagttattacaaaccacttagtactcagatgctcaatttttattaatctgatgcaaaaaccgcttcgtccgttcgtgttgaggattgctgaaaagttgctcaggcgagccttgttccacaatttcaccgccgtccatcacgaccacaacatctgccacatctaacgcaaacttaatttcgtgtgtaaccacaaccattgtccagccttcgtttgccagctctttcattgtgtttagcacatcttgcactaattcagggtcgagagcagaagtcggctcatcaaacagcattaattcaggttgaatggctaaagcacgggcgatgccgacacgttgttgctgtccgccagaaagctggaatggatagagatcgactttatctgctaatcccactttggctaataatgctaaggcttcttctctagcttgttcaggttttttaccttgtacaaacacagggccttctatcacattttcgattgcagttttatggggaaagagattgtagttttgaaaaaccatacctgatttatggcgtagagtaaggatctcttttttggctgatttggttgtaaagtcaatgtgcaacggggcatcgttatcaaaggttattgtgccttgctctggcacttctaacgcatttaaacagcgaagaaaggtagttttacctgagccagacgcccctaaaatcacaaccacttgccccttttgaatgtctaaatcaatcccacgcaaaatggtgttattgccaaaagttttatgaatgtttcgtactttaatcattgttatttcgccacatatcgatcaaaacgtttttctaagcgtgcttgaataaagaacagcacccaacagaaacaccagtaaatcaagccagcttcaatgtagactggtaagaagtcataggacatatttgccacttgttgagctacacggaacatctctgtgaccgtcacaacagatgccagagaagtatctttgaatagaccaataaaggtattactcaatggcggtacggcaacacgaaacgcttgtggtgcaataatacggcggaatgtctgcatataggtcataccgatggtataacctgcttcccactgacctttcggcacagaaagaatggctgcacgaatggtttcagaaccgtaagccccgatattgatcgaaaaaccgataattgccgctgggatcggatcgatgaaaataccaatcgcaggcaaaccgtagaatacaatacagatttgtaccaacatcggcgtaccacgaatgattgagatatagcctttgacgaaccagagtaatagacgatggaacgggccattaacaggggtaacacgaactaacgctaccccaacggcaatcgccataccaataataaaggaagcaattgccaaagggatagaaactaaaaaggccgcttgtaccatcggccagaaaccatttatgaccagctcaacacgagcttcggtcataaatggtagagagagtaataaattatttaacactgatgtctttaccaaagaattgctcacctaatctcttaagtgtaccgtcttttttcaattcttcaactgcctgactgatttttgcaagggcttcggtgttgcctttgttcacaataaaaccagctcccactttatccgcagattgccaaactggttttaagcctgaatttggatttttcttcaagtaatctaacaatgcaagcgagtcattgaaggtcacatctgcacgtttttgttgaattaataataacgcctgagccataccatcaaccgcaacaagttcagccccatttttctgtgccagttcgccatagttagagcttaaggtctgagctgcttttaagcctttcacatcttctgctttgcttacacgggtttcatcattacgagctaataacatcgcaccagaccagctatattctgcagacttatcaaaggttgcctgacgttctggggttgttaagcctacttggtttgccacaatatcaaaacgctcaccttttaaacctgctaacattgcgtcccattgagtttctttaaaatcaacttttacgcctaatttttcagctactgcacgagtaacttccacatcgtagcccgttaatttaccgcttgcatcgtggtaagtgaaaggtgcataagttccttccgtacccacagtaatagtgcctttgttgttgatacgatctaataaagactcttttgccaatgctgctgtagaagtgaaaactgccgctaaagataatgcaacgattgataattttttaaacataataagttccttttgataggtaagattgattgcttgcaaatttaagggcaaattagaccgcttgcaaataaccaaatgaaatataaaacaacaaaaagtttggattgataagagattggtggctgttcagcgcctaacagttagactaagcagcccgattaacgtatagaggataaacctcacctatcgctaattcagggttttatttaatgatgaaattattgcttatgatttaacaatgactcccaagtttgaactattctcccgactgacgaaccaagttagctatatcgaatggcaagttattaaacgattcacatatattcaagtgcaattaaaagggctgaactagtctaacggtggggaagagattaatatacccatttatattatctataaggtcaagtagatactagttatttagatagaattgacctttttttcatctgataaaacaagataactagatttttgcccaaataatttctataattcaccgtaattttgagattccccccttagctcagtcggtcagagcaggcgactcataatcgcttggtcactggttcaagtccggtaggggggaccattcaaggtttgataaattttcttacattcccctttcaatatccttacgtacatagacatttaaaaaaacgaaggaagatgaaaataacatttttaatatttttcaaaagttataagcatacagggctaatagtctccactaaaaaatattaaactgtccttccttaatcagatagctattcttaatattatacagaagtatgaggtgattatataagcatcccagaaagtctagccactacacaaaacataagacaaatgagtttaagaatattcaaaccccattttacgcggcatcagtgaaaataaaagacatagtagacaaaataaaaaatgtggcattacggattaaataatgccacataaactcgacgatattgaggaatttcttcttattatttgataacgattataatactctaaatacgaaataaaggcgaagaaataattcaacttttttcaaaaattggagcaagatcacaaaatttttcacttcctcctaaaactctctacacatacccataacccatcaaccgctgataacggcgatcaagcaatgcttctgcatttaacggatccaagtctgctaaatcctcaagtaaacgttgtttcaaattcgctgccatctcatcaaagttacgatgagctccgcctaatggctctggtacgatattatcaattaactcaagttcttttaaacgtggtgcggttaaacccatcacttccgcagcggttgaggctttttcagcactcttccataagatagaggcacaaccttcaggggaaatcactgaataagtgctgtattgcaacatattcactttatcgcccacgccgatcgctaaggcaccgcctgaaccgccttcgccgataaccgtacagataacaggtacttttaaggtggacatttcacgcaagttgcgtgcaatcgcttcagactgcccacgctcttccgcaccaatgcctggatatgcccctggcgtatcaatgaaggtgatgatcggcatattgaaacgttctgccatctgcattaaacgaagggctttacggtagccttctggtgctggcataccgaaattgcgtttcactttttctttcacagtacgccctttctgatgaccaatcaccatcactggacgaccatctaagcgtgcaataccaccaacaatcgctttatcatcggcaaaagcacggtcaccagcgagttcatcaaattcggtaaaaatacgctcaatataatctaaggtataagggcgacttgggtggcgagccatacgagaaatttgccacgcatctaaatctgagaatgttttcttggtgagttcttcactttttttctgtaaacgtgcaatttcatcatcaagattgattttgttgtcattacctactgcggaacgcaatgcttcaatttttgcttcaagttctgcaatcggtaattcaaaatctaagtattctgttgtcataatttttcctatctgttttggcagaaataaaaaccgctgtattttatcagtgaatgtgacataagcggtaagatttccacatttttttgcaaattttctcgctgatccgaccgcttaatgctattccgcaacaacaaattgccccatacagccacgatctcgtaacattaaatcggataccccgaaggtgaatggctgttgctcagaggctgtatgctcaaacttaactaacaatgtagtttcttgggttggttctaaccatacacaatctcgccaagccaactgtttatgaggcacagcctgacgatttctcgtttccaccataaatttggcaccctgtaaggtaaaaccaacctcttccgttgtggtcaaataccaacgttccaccgttcctttttttaccgtaaaatcgatccgcttaggatcaaatcgttgatgattgattaaacggtcttgtgggcggagattgattttacgttcttgggtaatttttaagttaaactcttccacattaaatgggggaagttttggtgtcacatttaacgctgaaggcaacccctctgggcgaaactctaacaccacattatcatttaactcattgttatctttgaataatttcccaatttcatcaaaaaaatctcgcttcttgccagtgattaatgaaaccttatctccctcatttaagtccactaaaacttcaattcgttccgatggagcaagggaaatatgttccatttcaaccatatccgctaaaaaaccaatccccgttgcaattaaatagagcggtttgccattgtctaaacgtaaatcataatgacgagagagggaagcattcgcaatccgcaaacgaacccagccacgaggtacatcaaaataaggactttcttgcccattcacaaacagacgtttgccaaaaaattgattagtctgagtgtcaattacttgaataccatcactgttaatcaactgatcttgcaaaatcagcggaatatcattaaccccatatttattaggtagtgacgcttttctactttcactatcttcaataatccacaaacctgccaagccacgataaacttggaaagcggaatttaacattgtgtctgcgtgataccaagccgtacaagcggattgattaaccgataaaatcggcgaccaactgctgtttttgtctatagcacggtgaatagagccaatcatttccgttggagcctgtagcccttggatattgatcgataatgcttgtggcaggttgttagtataggtcagcttgacaaaatcacctgacttcactcgtaccgtgggggcaagataacgcccatttacaccccaaacatcaaccagtttccctttattaaattgcgtttgagcaggacgaaaatccaatcgaacaggacgaccacgccccacttcaatcatcggcggaatggttaaactaggacgatttttcgcccataacgacgtaggggtaacagtagctaccccagctaatgtagagcgttgtaaaaattgacggcgagaaagtttcatattatttacgttctaattgagccacttcttgatccaattgttctattttagcctgcataatttgatgacatttttcgataagctctttgagattttcacgatcataacccgacgtatcaatcggttctaattgctcgcaaatcaccacaccattgtccttacgatttaagtcaattttattatgagtcgttgaacagacaatcggcacaatcggcacaccagctgcaatcgccgtatgaaatgcccctgttttgaaaggtagcaatccacgcccgcgactacgtgttccttctgggaacatccataccgagatttgtttgtcacgaataatctcgccaaccttattcatcgtattaatagcactactacgtttttcacggtgaataaaaatattccctgttgcccaataaactaagccaaaaaaaggaatccaaatcaagctacgtttaccaatgctcacggttcttggtggtaccattgctgcaattgtcaccatatcatagttattttggtggtttccgatataaatagctggttgattaaatgtcgctttattgcgtgtaattaatttaatgccaaccaacttatgcagtgaaccaaacatatttgccacaacgctaacactatctggatggcgtaaccgtactaacgcataaagcgagccaacaatactgattaacatagcaaaggaagctactgcaacaatgcgaaatagttttaacatagtaaaaaacctttaagaagaaatattatagaaagtatagccgagatgtcctcatttgccaaaaagataagcatcaactattgctaaaattcattttcattttgttaagaaatcgttatattgagcaagttttttcaacctatttaggagttattatgagtcaagttacattagctggaaatgctatcgaagttacaggtcaattcccacaagcgggtagttcagtggcggattttacattagtgagcaatggcttagaaaacgtatcactttccgacttcgcagaaaaacgcaaagttcttaacatcttcccaagtattgatacaggtatttgtgcaacttccgtgcgtgttttcaataaagaagcagccgaactcgcaaacacagtggtactttgtatttctgccgatcttcctttcgcccaagcacgtttctgtggtgctgagggaattgcgaacacccaaacactttcaacattccgcaacaaagccttccatcaagcggtaggcgtagatattgcaacaggcccattagcaggtttaactgctcgtgcagtgattgtattagatgaaaacaataaagtgctacacagtgaattagtccctgaaatcaaacaagagcctgactatgcagcggcgttggcagtgttgaaataagacgattcattgaatgataaaggacgccagcatgacgtcctttatcacttaaacaatatctaataattctacttcaaaaattaacgtgctaaatggcggaattgacgcacctgcaccacgctcaccgtaagcaaggttatgtggaatggttaaacgccattttgaacccacaggcatcatctgtaatgcttcaacccaacctgcaatcacacctgtcactgggaactctgctggtgtaccacgttttactgagctatcaaatactgtgccatcaattaatgaacccgtatagtgaacacgcactttatctgttttcgcaggcactttacctgtaccttccactaccacttcatactgcaaaccactttctgtttctttcacagatgggtgttttttattctcatctaagaacgctttaccttctgccgctaacgcttcaaaggcttttgcttgttctgcttcggcacgttgagataactcttgtaacgctttggttacttcattcaaatctaatgcaggtgggctttgatttaacacatcaaaaatcccttttaccacagcttccggttcaacatctaaaccactgcctaataattgctgaccgatttgtaaaccgataccataaccgccttttgcttcaacgctttctaatttcacttgttctaaatttaaagacataatttttccttatgtgtagaggggatccccccgttaatgtgtttatataaattcgggcgaggataaacctcgcccctacattcattaaaataatgactgctgtaatatagagccagattggcaaattacaagtacaagcggtctgattttggcaaaaatttgcaaatttcagctagtatgccgtagctatacaacagggtatgcagatatcataagacacatctacaaaatagcatttgctgtatctttttgtatttactttttaaaaattgagggggcacatcagcccccatctaacgctaagtcgccttatcttttcatttaagtaaaattactgtttttcaggtctatggaataaggtgaatgcgataaaaccgaatcctaagaaacaagatgcgactaaggcatagaaaccaccgtcccaaccataaacatccactaatttacccattacccaacctgcacttgcagaaccaagtaagtaaccgaataaaccagttaaacctgttgctgtacctgttgcaacacgtggaactaaatctgctgcttgtaaaccgatcatcattactggaccgtagattaagaaaccaatcgccactaagcagatgttatcaactaatgggttgccagctgggtttttccagtaaactacaatagcaattaatacaccaacgaggaataataacattggcggtgcacggtgacctttgaatactttatcacttaagtaaccgcttgcgagcataccaaagatacctgcgtattcataaaggaagtacgcccaactttgtttatctacggtaaagtgtttaacttcttttaggtaggttggcgcccagtcaataatcccgtagcgaatgaagtaaacaaacacgttcgcaatcgcaattgcccataagaatttattgttaatgatatatttgtagaaaatatcttttgaagaaagggtatgtgctgattccactttttctaatactttctcgcctttccactcatcaacaggcggtaaaccttgtgattcaggtgtatcacgcattaagtaaagcaccacaaaggcaagtacaatcgcaatcaatgctggtaggtagaacaaggattgccatacgccgaagatagataaacctaaaatcgccaatggaccaatcaaaccaccacctaagttgtgtgacacgttccaccaactccaccaagctccacgttcagaacgagagaaccagttggtcattgtttttgcacctggtggatagcccattccttggaaccagccatttaaggctgcaagtaagatcattaatggaattgaagaaagtacaccaggtactaaaccaaaaatcaagctgatgatggcagaacctaataaaccaatagtgatgaaatattttgggtttgagcgatctgaaacatttcccataatgaatttactaaatccataagcaagggataatgccactgcgaccgtaccaagatctgctttactaaatccatattcgtcgattaaataaggaatggctaaagaaaagttcttacgaatcaaatagtaagctgcatagccaataaatacaccagcaaatacttgccaacgtaatttgcgatattctgcgtctgtacgagaactttcaattctcggtgcaggtgcagatgcctttagaaaagaaaacatacaagctcctttgtaacttttgtgattttgaaaaattcgatttcaaacattttatgttcggatgtgattatttatctgaaagactttacattgcaaatgtattttgtaaattttgtgatgtaaatctcatttatttggtgaatttgtatataaaaacaacaggttaaaagacacaatcgtttacataaattgaattttaatctcaccttttgcaaaaaatcgcctaaatccgaccgcttgtgattgactaaccgaagtgaacggatacaatcattccatttccgattactcataataaaggacaacattaatgaacctatacaacatcaaacaccctgaagaacaagtgaattttgcccaaggcgttcgccaagggttaggcaaagatcagggcttatttttccctgaagtgttacctaaatttgacaacattgacgctttattagcattaccgctggttgagcgtagccaaaagattttatcggcattgattggcgatgaattaccacaagaaaccttaaatgcaatggtaaaaaatgcctttaccttccctgctccgttagcgaaagtgaatgatgatatttatgcgttagagttattccacggaccaacccttgcttttaaagactttggcggtcgctttatggcacaagcattaagtgcggtgcgtggtgatggcaaaattaccattttaacagcgacatcaggcgacacaggtgcggcggtggctcacgctttctatggtttagaaaacatcaatgtggtaatcctttatccgaaaggtaaaatcagcccgttacaagaaaaattattctgcaccttaggtggcaacattcgtaccgtggcaattgagtcggattttgacgcttgccaagcgttagttaaacaagcctttgacgatgcagaacttcgtcaagctatcggtttaaactctgcgaactctatcaatatcagccgcttgcttgctcaagtgtgctactactttgaagcagtggctcagttgccgaaagagaaacgtagcgatgtggtagtttctgtaccaagcggtaacttcggcaacttaactgcaggcttaattgccaaaactttaggcttaccgattaaacgttttatcgcttcaaccaatgcaaacgacactgtgccacgttatcttaaatcaggtaaatgggagccaaatgcaacggttgcgacactgtcaaatgcaatggacgtaagtcgtccgaacaactggcctcgcgttgaagagctgtttaaacgtaatggttggaatttggcgaatttaggttcagatgccttaaatgatgcagaaaccgaagaagcattaaaagcacaatatgcggaaggttacttatgtgaaccgcacggagcaatcgcttaccaagtattgaaagatcagctacaagctggcgaaacaggtattttcctttgcaccgcacaccctgcgaaattcaaagagagcgtagagcgtattttagacattgaactgcctttacctgaagcgttagataaacataacaaaatggaactgttgtcggacacaatggcggcagattttgcgaagttaagagagtatcttttaaaatagcattccctataagcggtaagatgaaggcaaaatacattatcttaccgcttatttttataccaaaaacaacacaggaattaaattcatcaccatcatcgtcaaaatcgactggatcaagcgggacgatccgaagataaatccacgatttttaccgttatcaaatttcactaataaattcgccattgccgttaatgcatacacttcaagcaaggtaaaaatcaccagatagagatagccagaaaccaacgaagcataatgcaaggtgataaaccaaggcacaaccataccgacggctaaaatcgggctaacgaaaataagttgcttacgggttaaattgatatgcttggagaaatacgattgtagggcaacggtcatcaacccattgataaataacgcaatcgggatctgctctggggcattgagtttattgtcaaacagataaggaaaaatcacaaaaaacgacattgcaacacttaacggtacaaacagcattaagtgaacaaaaataaactctttggtgatgatttcccgaatttgcccccaacgaaatttcactaaattgttcacattttccatttggtagaacggctttgccataaacacaaataacaccgcttccaataaaaaacagcaccagattaacgcattgatctgctcatacttgataaagggaattgcaagcaatggagctgccatcgacgacatactggtgacccgtaagaatttgccttgtaaacgggttttcgccgcatattcatcgccagccaatgcaagtaagcacgcccttgcattagttgcaaacagacaacttcccataccaaagcacattgtcgccattaatagcaccgtgtagctttccgcagacaagaagaaaacataggcgatcacatcgagcatacagccgactaacatcattttagccaaaccatagcggtcgcctagcacccctgcaaaaattgcaagggcttggctacaaaaaaacagtaccgacaacgaaaatgcgatctgagcgttagataagcctttttgttgcaggtagataaaaaagaccgtttgcattgaaaaataagcaagggtcgaaataaaacgacgagtgagtagtagtttttctaagaacatttgaatatctataaacggctatctgaatatgtagctaatcctatgttatgaatatattttacaatgttgattttttatataaagaactattattcatatcgtgctttaattattctctattatacaaagatcatcattattggtaagcattttaagattcactcacataatacaaacgctcctattcccttcaatcttttgcaactcgcccccatagcgagtacaattcttccatttgcaatatttcggataaatcaaaccgcttgtatgtcatttgaacttcaatttcgtctgccgaaagcggacagcacacatcaagatcatcaaactttaggcaatttaatcgggcattcggatacccttgcgattgtgcaggctagccagcagtttcaaggcttgacggtggtggtgacacctgatactcgcacagcgttgcggttggaaaaaagtttgccgagcttcacgaaactgcctgttcagctttttcctgactgggaaactttgccttacgacaatttttcgcctcatcaagacattatttccgcccgtctgtctgcgttatttcagttacaacaagggcagaagcagattttcctgttgccaatcaacaccttattacaaaaggtttgtctgccaagctatttggcgaacaatgtattgctgattaaaaaaggcgaccgtttttcgattgagaaattgcgtttacagctggaaaatgccggctatcgagctgtggaacaggtgctggaatatggcgaatatgcagtgcgtggagcgttgctcgatctctatccgatgggggcgaattcgccttatcgtttggacttttttgatgatgaaattgacacgatccgtacctttgatgtggataatcaacgtaccattgaacagatagacgaaatcaatttattgccagcccacgaattcccgacagatggcaacgggatcgagtattttcgtcgcaagttccgtgaacaattcggtgaaattcgccgtgaacctgagcatatttatcagcaggtgagcaaaggcattttgaatgcagggattgaatactggcaaccactcttttttgagcaaatggcgagcctgtttgagtatctgcctgaacagacgttgtttattacctttgccgatattcagcaaaaagccgagcaatttcaacaagataccgcaagacgttatgaaagtcgccgtgtcgatccgatgcgaccactacttccacctgaacagctttggttcaatatcgatcagattaaccaacagctaaaaggctatccacgtttaactttaaccaacgagaaagtccgcagttcggcggcgaagcagaacgccaaccttgagccgttgcctgacattgctgtgcaatccaatcaaaaagaaccttttgccgcttttttacagtttcagcagaaatttaaggggcaaatccttttttcggtggaaacggaaggcagacgggaaaccttgctggagttacttgcgccgttaaatatcaaaccaaagcaagtgaagcaactggctgagatcaattcgccaatttctttactgatctcaccgcttgatcaaggttttattattgaaacaagcggtcaaaaactggcgataatttgcgaaacggatctgttaggcgaaaaagttcagcaaagtcgccgacaagagaaaagccgtaaaaccgttaatcctgatactttgatccgcaaccttgccgaactgaaaatcggacaagcagtggtgcatttggaaaacggcgtggggcgttatggcggtttaaccacccttgatgcaggcggcattaaggcagaataccttgtgttgcattatgccaacgatgccaaactttatgtgcctgtggcttcgcttcatttgattagccgttatatcggtggcacggacgaaaatgccccgttgcataaattgggatcggaagcttgggcgaaaactcgccaaaaagcggcggagaaaattcgtgatgtggcggcggagttgctggatgtctatgcgaaacgcgagtcgcaaaaaggctttgcgttcgagtatgatcgtgatgcgttcgtgcaatttagcaacactttcccgtttgaagaaaccgaagatcagaaaacggcgatcaatgcagtgattagcgatatgtgcttgccgaaagcgatggatcgtctcgtgtgtggcgatgttggctttggtaaaacggaagtggcaatgcgagcgaccttcttggcggtaatgaaccataaacaagtggcgatcctcgccccaacaaccttgttggcacaacaacattttgagaattttaaagatcgttttgccaattatccgatcaacgtggaagtgctttcccgtttcaaaaccgccaaagagcagaaggaaattctggcaaaagtggcggacggcaaagtcgatattttggtcggcacgcataaattattgcaagaagatgtgcagttcaaggatcttggcttgctggtaattgacgaagaacatcgtttcggtgtgcgtcaaaaagagcgaattaagcaactgcgtgccaatattgatattcttacgctcacggcaacgccaattcctagaacgctcaatatggcgttgaacggaatgcgagatctgtcgattatcgctagtccgccggctcgccgtttatcaatcaaaacctttgtgcgacaaagcgatgatacggtgatcaaagaagcgattttgcgtgaaattctgcgtggcggacaagtatattatttgcataacgatgtggcgactattgaaaatactgcacaacagcttgccgaactggtgccggaagctcgcattgtgatcggacacgggcagatgcgagagcgtgagttggaacgggtaatgtctgatttctaccaccaacgttttaatctgttggtttgctcaaccattattgaaacagggattgatgtaccgaccgccaataccattattattgagcgagcggataaattcggcttggcacagctacaccaactgcgtggacgtgtcgggcgttcgcaccaccaagcctatgcttatatgctaacccctccaccaaaaacgctgactaaagatgcacaacagcggttagaagcgatgagtagcattgataaccttggagcaggctttgtgctggcgacccacgatcttgaaattcgtggggcaggggaattacttggcagtgaacagagcggacagattgagagcttaggtttctccctctatatggaactgcttgaaaatgcggtcaaagccttgcaagaagggcgtgaaccgaccttagacgaaatcacccaacagcaagtggatattgaattgcgagtgcctgcgttactgcctgatgattatctgcctgatgtgaatatgcgtttgtcgttctacaaacgcattgccagtgcagagagtgatgaagccttaaaagatctgaaaattgagctgattgaccgcttcggtttactgccagaagccacgaaaaatctgttccagattactcagttacgccatttggcaaaagggttgcagttgaaaaaagttgatgcagggatcaacggcggttatctagagtttaaaccaaccgcaacgcctgatccgatgaagtttttaaagctgatccaagcggataaaaatgtctataaatttgacggcccgttgaaattccgctttaccaagccaatggaacgaccagaagatcgcttggcgtttgtggtggagttgattgagaaaatacgttaaaagcaaaatagccacgttatacgtggctattatctggtgacaatcattgaagttgaactaattaatgcagcgaacaccactttttttgatttaggcttaaaggacaaaattaaatatctatagccaccctttgcgtttaaaataaagatatggtgtcgcagcagcacaaatcattaagccaatcgccattggataaccatatttaaatcccagttctggcataaactcaaaattcataccgtaagtagatgcgaccaatgttgcaggaaggaacatcacggacactaccgagaaaaatttcataatacggttctgctcaatattgataaaacccattgctgcttgcattaaaaagtttaccttttggaaaagcgattcgttatgcggttgaagtgattcaatatctcgcataatatcacgagcttgttcaagctgattatttggcaaacgggttttacgcaataagaaactcaatgctcgctgagtatccatcaaacatagacgaactttagaactggcatcttcaagttccgttaattcagcaagggcatcatcaaagttatgctcacctttattttcaccctcatgagtactgagaaccacacggcttaatttttctaaatctgcatagatattctcaataacatctgccaactgctcaattttagtttcaaataggtcaagcagaagctcgtaagcattgccatctatcaattttgctcggcgagaacgcatacgatacaaacggaaagcgggtagatcccgttcacgcaatgtaaataaacgtccgtcccgaatagtaaaaccaacagtagcaatatcggcatagtcgtcatcatctaaacagtagaagaatgagtgtaaatgtaagccatcttcatcttcaaaaaaacgagcagaagcttctaagtcttccaattcgtgttcttccgcaagggtctgatctagtcgcgtctctaaaacaccacgttcttcatctgtaggatcaatcaaatcgatccaaatagcttcattaaattgattttgaatattttcatctacactgactaggcgatcgttatttaacgaaaaagctctgatcatttcatactcctaaaaattggatatgaggcgatgaacaaaaaggaacaaaatataagatactgataagaattaccgacgctcgtcggcaaagatgttttggacgaggtgggttaaaaaactgataagtatcgactgtgactgtccaaaatgtgtatcctcaagtaaaaaaaacgcgcgaatggtacagatttagaattgagccgtcaaggaaaatgacattatttttagatggagaacaatgccttacatctgaacaggcgctattattcaagattgcgataacataaagttttgattaaaatgctcgccaacttttatatttaggaacggacaatggcagattggaacggtgaatatatcagcccttatgctgaacacggtaaaaaaagtgaacaagtaaagaaaattacggtatctattccgattaaagtattggaaattttgactaacgaacgcactcgccgtcaaattcgtaatttacgccacgccacaaacagtgaattgctttgtgaagcgtttctgcacgcatttacaggtcagccattgccaaccgacgatgatttaatgaaagaacgtagcgatgaaattcctgaggaagcaaaactgaaaatgcgagagctaggaatagatccagataagtggcaatattaaatgatttcaaacctcacaactgcgaggttttattttagctaaaaaataggaggactatgaaagtttctaaacaaatagatcgtgaagtgcgttgggcattatatctgacgctattttatgttatgggttgggtcggttttgcttatttttcacctgcagggcgaggttttttaggctttcccctctggtttgaattaagttgtgtctatcttccaatcgtattaacgttattgatcagcgcagtagtaaaatggatttatcaagatattgatttagggggaaaagatgaatcttgagttgttgttacctttaatcgcctatctcattttcgtatttggcgtagcctattatgcctatcgccaacgtacaagcggtagctttttatcagaatattacgtcggtggacgctcaatgtctggttttgttttggcaatgacaacggctgccacctatgttggagcaagtagctttataggtgggccaggtgcggcatacaaatatggcttgggttgggtcttattggcaatgattcaagtgccagccgtattgctctcattaggggttgttggcaaacgcattgcgatgtttgctcgccaaaacaaaagtttaacgatcaacgacttgttgttaacacgttatcaacatcgctttgtggtgtggattgctagctttgctctgttactctctttttttgcaatgatgaccgtacagtttatcggtgctggacgtttgcttgaaactacgcttggcatttcctacggcaccgcgatcattatttttgcggtcactgttggtatttatacctttatcgggggctttcgtgccgtcgttttgaccgatacgattcaaggcttagtgatggttgtaggcacattactactgcttggcggtgtaatttatgcaacgggaggcgttgatgctgcaattacccagttagaaaatatcaaccctcaactgactgcaccttatggtattgatgaacgtccactagacttcacctttatgacatctttctgggtattggtctgctttggtctaattggattgccacattttgcagtgcggagtatggcatataaagatagcaaggctttacatcgagctttgattattggcactgtcgttgttgctgtgttgatgtttggtatgcatttagcaggtgcgttgggacgagcggtgattcccgatctaaaagttgccgatcaagttatcccaaccttgatgttacaagtacttccgcctgttgttgcaggcattttcttagctgcaccaatggcagccattatgtcctcaatcgactcaatgcttattcaatcttcttcaaccctgattaaagatctctatctcgcaattaagccacaagcggttgaaaatgaagaaaaaattaaacgtttctcgacaatcactaccctagtgatcagcgttttattggtgatcgcagccattaacccacctgaaatgctcatttggttaaacttactctctctgggagggttagaagcgacattcttatgggtaattgtattgggactattctggaaaaaagcgaatgcaacaggggctatttgttcaatgattgcaggtttatcaagttatgtgttaatgacaagcctatctatcaaaatatttagctttcacgccatcgtgccagcattagtaattggacttattgcttttttagtgggaaatcggtgtgtaacattaaaaaaggactagaaattattagctaataatactttttaacgagaaatgccttttcatatagcttaaagtcttataataaagactttaagctatttttattctatgagccatttttataagtaacgcttagacagataaaggtattgagattaaaccagaaatgtctgatatgtatcttcaaataaggataaaaggacacagcgctattaaatatagcactcagcccttctattaaaaagtctagcttttagtgtagatcaaattgaagttctactagagtaaaacattcgctaatactaagccaaacactaaacagaatgccatgcttaataagcctgggatcataaagctgtggttgaaaatgaatttaccaattttggttgttccagtcgtgtcaaagtcaatagacgcaatgattggaccgtagttaggaacaaagaagtaaccgtttactgcaacgaataccccgattaagattggtgcagggatacctaacgctacacctaacgggaatagggttgctactgttgcaccttggctgtttactaatacagaaagtacgaacaatgcgaacgcaaatgcccacggtgcagtttcaactaagcctttcaccatatctttaacttcggtcatatgagcgtccattaaagtatcgcccatccaagcaataccgaagattgcaataaccgcacgcatacctgcgtggaatacagaaccttgtgtaatcgcattaccatttggtttgcagataagcataattaatgcagccacagtcagcatcacgatttcgatagtatgagccattcccattgctttgccgtcgaatactgggcgtaactctttgaatgaacccataaacacaacaagtaatgcaccaaataagaataaacttacagaggttttagccgttgggctaatttggatctcagctgggtttgtatctgcgtgatttcttgccacatactcaggatcttgtaataaacgttgataattagggtcgtcttttaactctttacccattttatttacgaataaacacgcacagaaaagacctaaaatcgtacctggaatagtcactaataaaatgtcaccaatgctataaccttgtggttcgatcattgcagcaacagacactaccgcggcagcaatcgggcttgctacaatagcaaattgtgatgcaataacagccattgaaagtggacgttcaggacggataccgttatgacgactaacttctgcaatcacaggtaatacagagtaagcaacgtgacctgtacctgctaagaaagtaaatgtccaagttaccgctggtgcgatgaaagtgatgtgttttggattacgacgtaaaatgtttgttgcgattttgatcatatagtctaaaccgccagcggcttgcattgcagccgctgcagaaactacagccataatcataaacataacgtcgattggaagacctgcaggttttaagccaaatccaaaagagaggattgccaaacctaaaccgcccattacccctaaaccgataccaccgaggcgcgcaccgattaaaatacagagtaatacaacggcaaattcaataagaaacatagcagacataattggctccattgtaatttaatgaaaaagccctcatactgaggaagagttggcgattgttcgcccttttataaaaggcgtgcaatatagcataaaaatttataatcgttataatctagatcaataaaaaattctaataataggaaaaattatgcagttttcaaaaatgcacggactaggcaatgactttatggtgattgatggagtaacgcaaaatgtctatttaacggaagaactcattcgtaaatgggcagatcgccatcgtggtgtaggttttgatcagctactactggtcgaaccaccctatgatccagaactggatttccactaccgtatttttaatgctgatggcagtgaagtctctcagtgtggaaatggagcaagatgtttcgctcgttttgttaccttaaaaggcttaaccaacaagcaggatattggtgtaagtaccgcaaaagggaagatggttttaagcttacaagacgatggtcaagttcgcgtaaatatgggggaaccaatttgggaacctgcacaaattccttttaccgcaaataagtttgaaaaaaattatattttacgcacggatattcaaacggtgttatgtggtgtggtttcaatgggcaatccgcactgtgtgttacaggtggaaaatattcaaaccgccaatgtcaatgaattgggggctttacttgaacgccacgaacgtttcccagagcgtgccaatatcggttttatgcaagtcatcaatcgaaatcatatcaaactaagagtgtttgagcgtggtgcaggcgaaacacaagcctgtggtagcggtgcttgtggggctgttgcggttgggattatgcaaggcttattggatagccgtgttcaagtagatcttccgggtggaaccttgcatatcgaatggcaaggtgtgggttcaccgctttatatgacaggtgatgcagaacatatttatgatggggctgtgaagtcataagttatagaatatgagatatattggaataaacggagtagtttaagatccaaatatatattctggtactacaggcataaactacactatcgttatgcttttatgaactatagtcccaatcttcttgagattatctagcttggttttagtttactatttcagaataaagataattacttttggatgaataacccgcaatattctattcatcctattggagtattactggaatactttgtaggaacttaaaaaatattgattgtatctgagcaagggctttttcatgataaattatgatcttgttcaaattttaagtaaattttctacaaatgaagcaaatctttctttataatgatcgtcaatgaagttttatttcaaatttgactttttctaggaggatttatgcgtttagtgcctttggattgtgctgaacaagtgagccgttgggctgctcgttatattgctgataagatcaatgctttccaaccaacagcagagaaaccttttgtgcttggtttgccaacagggggaacgccacttcaaacctataaagaattaattaagctgtatcaagcaggtgaagtgagtttcaaacacgttgtcacctttaatatggacgagtacgttggcttaccgccagagcacaaagagagttaccactattttatgttccataacttctttaaccatattgatattccagtagaaaatgtgaatatcctaaatggaatggcggaagatgtagatgctgaatgtgaacgttatgaagcaaaaattcgctcttatggcaaaattcatctctttatggggggggtgggtgttgatgggcatattgcctttaatgaacctgcttcatcgttaagttctcgcactcgcatcaagactttgaccgaagatacgttgattgcgaactctcgtttctttgataatgatgtcaataaagtaccaaaatttgctttaacagtgggggttggtactttgatggacgcagaggaagtattaattttagtcacgggttataataaagcccttgccttgcaagcctgtgttgagggggcggtaaatcatttgtggacgatcagtgcgttacaattacatcgtcgtgcagtcgtggtttgtgatgaacctgcaacacaagaattgaaagttaaaaccgttaagtatttcaagcaattagagcaaaatatagctcgctaggaggaaaagatggggcgttatgcactaacaaattgtgtgatttatacgggaagtgatgtgctatatcaacatgcggtgatcgtcaatggtgagcagattgaggctgtggttcatcaaagtcaagttgcagatggggttcatcagattgatttagagggcgcaaatctttctgctggttttattgatctgcagttaaacggttgtggcggtgtaacatttaatgaagatattagtgttaaaacccttgaaattatgcaagaaactaacctgaaatcaggtacaacaagttatttgccaacctttattacttcgcctgacgaaggaatgaaacaagcagtgcaagtaatgcgtgactatttggctaaatataaaaaccaagcactcggtttgcatttagaaggaccttatttaagtgtggcgaaaaaaggggttcatcgccctgaatatatccgtgaaataagcggtgagatgttggattttctttgcaaaaacggtgatgtcattacgaaattaacactcgcagcagacaacccaacggcagatcatattcagaaatttgttgaagctgggattattgtgtctatcggacactcaaatgcgacctttgccgaagcaaaacgacgtattgagcaaggcattggctttgctacccatttgcataatgctatgtcgccgatcagctctgggcgcgatggtggagtagttggtgcagtgttggatagcgatatttacgctggtatcattgtcgatggtttgcacgttgattggagtaatgtgcgtattgcgaagaaagtgaaaggcgataaattggtgattgtaaccgatgcggttgccccagctggtacaactgatatggaatattttatctttgtaggtaagaaagttttgtacaaagacggtaaatgtgtcgatgagtgtggcagtcttggcggtgcggcgattacaatgatcgagtcgatccgtaatatgatgcaacatactgatcttccgttagatgaagtgatccgtatgtgtacattatatccagctcgtgctattcatgttgaagataagttaggatccattgaagctggcaaaattgccaatttaactgcgtttaatcatcagtttgaggtattaggtacagcggtgaatggaaattggaagtgggctcagctctaatgtgttgagtgagcttaaaaagatcgtttaaagatccttctctaaacgatcttttttgtttgtttttgaagaatttcaaatttttctcaatttcttgcttgctctcatttgagtttttgcgtagaattgtccacctattttatatgaatttgagagtgccaaacgcatagcgataggcacatattagcggagtaaatatgtacgcagttttccaaagtggcggcaaacaacaccgagtgagcgaaggtcaagttgttcgtttagaaaaacttgaagtagcgacaggtgaaaaagttgagttcaactcagtgttaatggtcgttaatggtgaagatattaaaatcggtaccccagttgttgctggcggtaaagtagtggcagaagtggttgcacacggtcgtggcgaaaaagttcgcatcgttaaattccgtcgtcgtaaacacagccgtaaacaacaaggtcatcgtcagtggttcacagaagtgaaaatcactgggattcaagcataatttcagaggagatcaagtagatggcaactaaaaaagctggtggttcaactcgtaacggtcgtgactctgaagctaaacgccttggtgttaaacgtttcggtggcgaatctgtattagcaggtagcatcatcgttcgtcaacgtggtacaaaattccacgcaggtagcaatgtaggtatgggtaaagaccacactttattcgcaactgctgacggtaaagtaaaatttgaagtgaaaggcgagaaaaatcgcaaatatgtaagcattattgctgaataatcttcaaaagaataagattaaaatgccccgctaatcaattagcggggttttttattaccattgaaacaaaaaatttatgtcaaaatcacaacctttacttggctttctctttgccttaactgctgtaatgatgtggggtatgttgccgatagccttgcaacaagttttgaaatttatggacgctcaaacgatcgtctggtttcggtttattactgcaatggtagggttgtttttgattttattctttgcaaaaaaattgccgaaagtgaccgctttcactcgccgtcattattatctgctattgcttggggtatttggtttatcctgcaatttttatttatttaatttagcgttaaatcatattccacctgcagccagccaagtgattagccctttttcatctttgattatggcgtttatcggtgtctatttgtttaaagagagcttcggtttacatcagaaaatcggctttgttattgtgctgattggcttggggttattttttaatgatcgttttgacgatcttgctcagatgaatgaatatgcttggggaatgatctgtgcagtcagtgctagtctgatttggatctgttacagcattgctcaaaagatgatgctagatcggtttagttcacagcaaattttactgtttatttattgtggttgtagccttgttttcacgcctttagcggatctttcacaggtcaatgatctcagtggctttgcactagcgtgcctgatcttttgctgtttaaatacggtgatcgcttatggtagttatgccgaagcattaaatcgttgggaggtgactaaagtgagcgtaatgatgccacttatcccgatctgtacaattttattttcgcagttggcattttatttaagccctgaacattttgctgaacctgattttaatcacttaacgcatttaggggcagttgtcgtggtatgtggagcaatgctttcagcggctgggcataaacttttttatcgacataaacggatttaatatgaaactacaacgtccattacttggattttcattagccttgcttactgcaatgatgtggggttctgtgccgattgcagcacaaaaagtgttgagtgttgtgaatgctcaaacgctcgtatgggctcgttttattgtggcagcaatcggtttgttactcattttaggctttacaaaaaaattgccaaaactgaccgctttcactccacgttttctttggttaatcgggttaggcgtggtaggcctatcgctgaactttttcttgtttagctatagtttaaactttatttcaccgacaactagccaagtattgtggcaattggcgccgtttacgatgattttatgtggtgtggtgatttttaaagaacaatttgggcgacatcagcaaatcggcttgctattgctcattattggtttaatcgccttttttaatgagcgttttgaggaaattttccagttaggcacttatgcttttgggttgcttgtcggtgcaggagcagcaattgtttgggtggtttatgcgatagcccaaaaaataatgttggcaaaatttagctcacagcagattttgctgattatttatacgggctgtgcattgctactcacaccatttgccagccagataaacatagatgaatttgatccgtttttattgggttgtttcattttctgttgtttaaataccttgattggctacggggcatatgccgaagcattaaatcactgggacgcatcaaaagtaagtgtagtcacgattttagtcccgatttttacgatggttttttcaagcattggacattgggcatttcccgatacctttgcaagccctgatatgaatttattgagttatatcggcgcatttattgtggtgtctggcacgattttatcggcggtcggacataaattagttaaaagaaaataagcatttccctagtttgtatgggaaataggagaagatatgaaatttattgacgaagccctgatccgagtggaagcaggcgatggcggtaacggctgtgtcagcttccgccgtgagaaatttattccaaaaggtggccctgatggcggtgatggtggtgatggcggtgatgtctatttaattgctgatgagaacctaaacacgcttatcgactaccgttttgaaaaacgctttgccgcaggtcgtggcgagaatggtcgcagtgcgggttgtacaggacatcgtggtagcgacatcaccttgcgtgtccccgttggcacccgtgcgattgacaatgatacccaagaagtgattggcgatttaaccaaacacggtatgaaaatgttggtggcaaaaggtggctatcacggtttggggaatactcgctttaagtcgtcagtcaatcgtgcaccacgccagaaaaccaacggcacaccaggggaaaaacgtgatttacagttagaattgatgttacttgcagatgtgggaatgttaggtttaccgaacgcaggaaaatccacctttattcgtgcagtatcagcagcaaaaccgaaagtcgcagattacccattcacaacccttgtaccaagtttaggagtagcacgagttggtgcggatcgtagctttgtggtggcagatattccaggattgattgaaggtgcggcggaaggtgcaggcttggggatccgcttcttaaaacacttagagcgttgccgagtactcattcaccttgtcgacattatgccgattgatgagagtgatcctgcacaaaatatctctattattgagtcagaactctatcaatacagcgaaaaattagcagataaaccgcaatggctggtgtttaacaaaatcgacaccattggcgaagaagaggcgagagaaagagccgaagcgattgtagaagagatcggttgggaaggtgattactacttgatttctgccgcaacagggcaaaatgtatccgctttaacccgtgatattatggactttatcgaagcaaatccgcgtgttgaagaagaggaaaaagcaaaagaagaagtcgcattcaaatgggacgactatcatcaacaagcaatgcaaaacccgattaccgaagatgattgggacgacttagatgatgacggttggacagaagaagatgatgaaggggtagagtttatttataaaccctaactttaattgctggaatattttaaattaagggatgggataccatcccattgcccttaattcataattgttagataatataggtggttacaagttttgatttaggacaaataatgagtgatatcttagtgcctcttatttttacagatgctgctgcaaaaaaagttaaattcttgattgaaggcgaagaaaacccagagctccgtctacgtgtttatattacaggtggcggctgtagtgggtttcagtatgggtttacttttgatgataaacttaatgagggcgatttaaccattgaaaatttagatgtagctttagttatcgatccaatgagtctccaatatctaattggagctactatagactatgttgaagggttggaaggctcacgttttgttgtgcaaaatccaaatgcaagttctacttgtggatgtggggcctcatttagcatttgagtattattccttccaattattaattcccttaactaaagtggcagtgtcttaacagtagcgtcatctagttagcaaaaaatataaccctttcccacagataattcggtattcacaaagttgtgtggataacaattaacgaggattcaaagagatcatggctttctctatattttattgcttgaaagattagttataaatatcagcaccttaatcagctagctgtttggtccaacttttagggtgcagatcattccctattacttcgccaacaaatcttctttttcaccataaactgggacaagagttttctggtaagcggcttttaatttgccgtttgctttaaagtccgcaatcgctttattcacaaagtctaataaagctttgttacctttttgtactgctggtgcgatattttctgttggacctacgttgccaatggcaacttcaaaggttgggttcgtttttgcccatgcccaaagtaacgcattatcgtgtgctaatgctacgccacgaccatcttttaacgcatcaaaggtttcggtgttttgatcgaatttcaacaacgtgatttcagggtgatttttggtgaaatacgcatcagcggttgttcctttgttcaccaataaggtttgtccttttaactgtgcaatatcggtaataggtgcaccttttggcgataccacacctaatgccacattcatataaggacttgcaaaatcaaccacttcttcgcgagctggtgtttgagtgaagttcgctaaaatcaaatcaactttattcgattttaaatactccacacggtttgcagcttcagttaaaacaaattcgactttgtctgggctacccagtaattcatttgcaatgtctttggcaatctcgacatcaaagccttgatttttaccgttaacatcgacataaccaaagggcggtttatctccaaaaacaccgatacgaataacgccattctctttaatttgagcaaagctgtcgctagaggcttgaacagtgtttgacacgccggcaaatgcaatggctgtggctaataatgtttttaatgttgtgctaagtttcataggtttctcctgtaaagtatattattgaatttgaacatttccccctttgaaaaagggggattaagagggatttctctaataatccataccgtgtaaaaattgtttagctcgttctgttttcggctgatggaaaaattgatgtggttcgctctcttcaataatagttcctttatccataaagataatgcgatcagccactttttccgcaaaccccatttcgtgtgtcacaattaacatcgacattccttcgtcggcaagttctaacaccacatcaagcacttctcgcaccatttcgggatcgagagcagcggtgatttcatcaagtaaaatcacttcagggttcatacataacgctcgaacaatcgcaattcgttgtttctgtccgcctgaaagctctctaggataagccgttttgcgatccagcaagcccacacgctcaagtaatttatccgcttgtgcttccgcttctgctcgctcacgtttttgtgctttcagcggacctagcagaatattgtcaatcacattcaaatgggcgaatagctcatagctttgaaacaccattccgaccttttggcgagaggtttcccaatctaaatctttgccaaactcgcctacgccagccattgaaatcgtgccaccttgtttttcttccaaaccattgacacaacgtaacaaggtgcttttcccacaacccgatggtccaagaataactaccacttcccctttgtgaaggtctaaacttaaatcaggaatagcaacggtgtcgccataggttttatgtaaatgtcgaatggttaataacggcataagttaatcatcagtgtcaatcaatggtgtgattgtgtcgtaagatgaaaagaaagggaaagtcttaaaaactattttttataaagtttagttataagaaaacggtaagatttgagtgaaatcttaccgcttacaaaagaaaaaaagcacctaactggcgcttcaggctgatgacaaaccatatattagatggattgaatattgtagggtgggttttaacccaccaataaaatcaatatgttacggctatatggtgggtcaagacccaccctacaagctctttgtcaataatctgaaagcacctaacaggtgctttataatagcctaaacccatctcttttctaaccaactcgcccacaacgacagcggataacagatcacaaaatacagcacaaaaatcaatccataaacgaagaaagaggcatgtggattggtaaatagtgaattttcaatgatctgctgtccgactttaaccatttcaatcacaccgattaatgctgcaagagaactggttttaatcatacgagtaaagagattgatagtactcggtagaactcgttttgtgccttgcggtaattcaatgaaccagaaaatttgccacggttttaaaccaatagctttggcggattcaatttgatgtttgtcgatagacgttaaagccccccgcaccaaatctcccatttctgctgttccccaaataacaaagacccaaatacagacccacaagccactgatatgaatattgaaccaagtagaaagcccgaaatagagcataaatagccaaactaaaatcggcacaattcggacggtttcgagataaagacgactaatggactgcactaaaatatggcgagatcgcataaataagccaaacaatgtgccagtaatcagcgagatcccaacggagataaaagaaatttctgcggtaatccataaaccctgagctaaccgtcgtgcattttcaccttcaaataaccaatcaaacgccatattttgctctccttactctgttttccgcataacgagccagtaatgaaataggtaataaaataattaagtaactgataaataacaggaaaagtgcttcgttcgttttatagtccataccaataatatctttagtcacaaacatcaattccgccacagcaacagcacttaccactgaagactctttaattaaaaacagtacatttgccccaaaggcaggtaatgaaattgcccacgcttgtggaaagataacatagcgaaaaatctggaatggatttaatccaatggacttagccgcttccgtttgtcctttaggtatggcgagcaaaccagctcgcagtgcttctgccatatagcttccgcctagaaaaacaagagcaatgacaccacaagtaaaaccgtcccacttaatgccgattttcggcaagccgtagtagagaaagaaaagttgaattaataaaggcgtattacgagaaagttcgatataaccacgggctagccaataaagtggcttgatgtgataagcggtaataactgcaatcactaatccaagcaaaaaagagagcaaaattccccaaaaagagagttctagggtaatcagtgcagcatcagcaaaacgtgggactgcatcaataagataagaccaattcattatgaataaaatattataaatagattgtagaatttattttgtcgtgcttgaaagagaaaataaagatgaaaacattctttgatataatgaaatggaataataatcaccaagataaatgagtctataactagatttgtgtaaatacctgtttctaaaatagtacattcagacacaggtattttttataatgaatgaaaagtggggaaaaacagctaaaattcactaaaataaaggtccttagcgattaagatcattgaaaatttactgcggttaatattgcattttgtttttttattcaactgctacataatgccgctataagaggctttaagccactttttagtggctattttgtattactccctttccgatacatacaaaggaaaatacaagaattattctatatcctctgattgtaaatccagcaactctggcgataacacaatccctgttaaatccgcatagacataatcttcaggtaaaaaggtcactccaccaaaattgacaggggtatcaacttcacccaccattgagtcatcagcaccaacaggaattggggcgagggcttggataccaatatctagggtttctaatacatctaattgacgtactgcaccattgacaataataccttcccagccattatccacggcaagttgggcgagttctgcatcaattaatgctcgacgcactgcaccaccgccatcgactaaaagcactcgtccttgaccttcttcttccaacacttctgcaattaagccattgctttcaaagcattttactgtggtgattttgccgtagaaagatgaaagtccaccaaagctagaaaaaataggttcgacgacatctacttgatcggaataaatatcacaaagttcagaagtatcaacacgcataacttgctccttttttcaattttattgttggaagtataaacctttgcacaattttgttcaaatctaaccgctttgctgagttgtattatgttctcgatgtatccgccataacattctggcatcaatgtttgatgatgaaatcattgttagaaaaacagctgctccaaaataaaaggctgcttcacccaccgagaagctgataatttgcccacgttcaaccaaagacatcatcagtgcaaggacaaacaagtctaacattgaccagcgtccaacaaagtgaacatagtgtagtagtttcatctgccagtgaattgggtgtttccagcggtaatggatcgcaagcaacaagtagaaaatcacggcaactttactaaacggcacggcaatactggcaataaagataatggctgcaattaagtaactgcccatttccataaataaaatcaccccgcccatcaatgtatctgcggaagttgtccctgcaaattcggtcgatgaaattggcaaaaggttggcagggatcatcatcactgccccagcaatcaaagtcgcccatactcgttgtagtttaatgctgtcggatacatctaaattgctttcacaacgtggacaacgatgtcgcccttttttatccacaatattttcatcaaaggtatattcacaagccgagcaaatacttggttggcaagggtgatccgcaggcaacgtacgatattcaggataaaaccgttcccaccaccgttttggatcgattttgataaacagtaacgtggttaaaatcgctgtcattatgaatgcgataatgtagtagtcaaactccaacttggcatattcacgcactttaaatgccgccacggcaatcgccacgagataaacatctaacatcacccactgtttcgctttgctgagtaaaatcaaggtgtagcgtggtctatggtggattagccgttgaataaagatcaacaataccaagccagcaaaggcaaaaggcataatcaccgaacagagcaaaatcataaatgctgtgtagggaaagccttccgtcgccattttccataccccccccagacggacgcataaatcggtactcctagtaggtcgatattcatcaacggcagccataagccaaaaggcaataaaataagaatagataaggcgataatggcacaacgtcgcaagctccaacggttaccagattgcaatacttcattgcaattcgggcaacaagcggtctgattgggtagatcttttgctatgctgacaacgctatcacattcaaggcatcgctgtaagtaaatctcgtcttttttcattctttggttaatcgctgtgcaacaggggcaaaacttttacggtgataaggggttacgcccagactttctaatttttcaaaatgtagcttggttggatagcctttatgctgtgcaaagccgtactcaggaaactgtttatccagttcgtccatttcctgatcccgtgccactttggctaaaatagaagccgcactgatttcagcaacaaaactatcgcctttcacgaccgcttgtgcaggcataggcaaagttggaatacgattgccgtccaccagtacaaaatcaggttgaatacgaagccctgcaaccgctcgttgcattgccaacattgtggcgtgcaagatattcagctgatcgatttcatctggctctgctcgccctaaagaccaacataatgccttcgctttaatttcttccgccaacgcaagacggcgtttttccgagagtttcttcgagtcggcaagcccttcaatcggctgattaggatcaaggataacggcagccgtcacgactgccccaaccaaaggtccacgcccaacttcgtccacccctgcaatgagctttgcttttggatattcaaacatcaattttcttccaagctataaggcagttcaaataatgccaatctgacattgccgacacggaaattagcttctggatcaagttctttattcagcactacttgtagccaaagctgttgttgataacgctggaccgctaaaattgtcccagtgtttttccagttctcgcccaactgcatttcaatgctagatgcaacggctggcaattcgatttccccttccacattacccacaaaggtaaacatcgcccgtttatttgcaccacgatatttcgcacgagccacggtttcctgaccgatataacaccccttagtaaaggaaatcgctttatcaagctgttgcagattggttgcctgtggaattagctcaaactgattagccttgtagagtaacggcacgccctgttgaatatcaatcagatcccacaaactgccatcgccattggcttctaccgcaatatcgccccaaaagatcgtccgtttaggctcttcatcaaggtaacaagcggtcacattttcgttaaattttgcaatgatctcaccgcttgtcgttccaaacagagcctgatctaattcagtaaaggtcactttggaaaacaccgcatatttctttaactgcaccagtgcttcaggcaacagattttgttgaataatcaggaaaaactgctccgccgttgcacgatataaacggaacaacgcactcatttttcctttcggatcacaatggcaagttaaggtctgctcaccaacagcaagtttcgctacatcacaagtaagctgtccttgcagatatttttccgcatcaatcccagctacttcaattaagcgatattgggttaaagccacacacaactcaggctgctgatgtgtcactttttgacattcacatttcatcttattatctcaaaatagggttaaaaacaggcggatcatacacgatttgcccgatgggataaattgatttgcagggggaaagttgctgaagaaggagctatggcactaagatattatttcgctttaatcccaacactttagtgattttggttattttcttattctctgtattaatcatttttataaagagatttctttctacatctgtagtcacatattcttcatagatctgtttaaattgttttagatactcttttgataagatatttattttatctctttcatcttctttgacaaaatccaccattaaatcaataagttcagattgaaaataattctcccactcttcattttttcgatgacaatattcatttaatgattttagcgtattaaaaacttgattgatatataaatggtaaaaatctgtatcaaaatcaattaattgacgatagccccaaataagttctttttctgcaaataaaatagagtgtatttcgtttgaattaatagccgtatctaaaaaccatttagctttaattatatttgctaacaagcagttttctacagagcgatgttcttgattaacatattttttagttctttttcttgtccttgttgatattttatgtaatctataaatttttgttttatttcatattcttgaattaagtcagctaaagtttggttattttcttttagtttttcaagttctaatattatttgtttttttgtgttatcgatttcttcagtcgcctctttgtgtttttccttaaactctttagttttctgctctatattaaaataagtataaaccgttcctatagctaaaattccacctaataaggtaaacacatctactgcggcttcccaagcaccttccttattgaaatgttgataaatagagaaacttgaaaaaacaaataatgcaatagaaaggtgaataatagttaaacaataacaaatgaatttattatacatagcaaaataacttattgttgatgttaccaaaaaatccacctttaataattttaagttaaaggtggtttatataaaatgttaatctaaaaatatactaaatatagatcattatcgaactacttttgggcggtacgctttacaaaagccctaaagtcctgtatagcttttgcaggattagaacatttagtctttgaccattcttcttcagcagcttcttcaatagccatttttaactgaggatcttgccttaattgggtgctcaatcgtagaaaattctcaagactaacaggaatattattttttttcgtatatgcagcaatcaaacgagatgatataagtggatgctcaagtacaccaagatcatagcttttctctgatgatgcaaaagagagcatttcatttcgtagagaaatccaattattgtattgttttgaatttttggggaaatgtgaaggacaaaccaaaggaaacataaatttatttgcaaattcacttattggatgtactttctccttttcttttgttgaattagaattaatttgtggttgagttggatacgtatttacatttggtaaattaacactgctaaaacaccccgataacacaaaagatatcgtaatagctgagaataattttttcattttaatactccttagtaggtattacacatcacctgaccaccaatcttattacagaaagtatttacaggacgattttgatagatttgttgaataacttggttgttttgttgttgctgagcttgataagccgcatcttgctgagcatcaaattgaacatctacagactgaacattattacttacggcagttaagctgtaagaatgactactggaattaacaggaaattggttgcgataagtatccgtagctcctcccatccagactgctttacaaggctgaacttgaacataaccacgctgaatatcactttcagaaatattgtagtaagcattgtatggcgtataacctacaaattgaccaccacaaatcagttttgcagactgtggggctgagttataccaaacgtgtaagccagatgaacaggcagataaacctaaacttatggcgataagtaataattttcggattgataagaacataaactaagaccttcggttaaagtggatttggttgataaatagataaattaaatgtttccaataacttgcgagtattttccttaataatcagttgattgttttataattatatattgttttttttttgcgcaataagatatgctagataatatgtagaagtaaggtttcaaaaggggaaagtactggtattgtggataatatgacacaaattgattaaccactcttatcaacaaatatttcccatttgaaccaactgatttttaggtatggaattttgttcattagtgttgaacggttttgttcattactattgaatagttttattcactagcattaaacaagttgtaccgttttggaagatgtttgggcaataacagtaacttattgaggaaaagcatagattaaatgtagataccataagacacaacaaattttatttcataaatgtgtctaaattaaatgctgtttgtttttgcaaaacagcctgtgcaatagtgactaatttacgcattaaagccgtgataatcaccattttaggtttgccgcattcaagcaatcgaagtacaaacgagcgatatacgctgtttttgtagctgccaaaggcaaagttcattgcagggcaaaagagtgccttacgaatgtcggattgcccgatttttgaaataccaataacggtatttaaactttttcccgaacttttaatcatcggggttaaacctgcaaaagtggcggctgctttcgcgtttttaaaacgattgccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggcaatcatctgctgtgttgaagcaatgcaatcgctgtcaagcaacatcgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgcactgcatttagggttaatcacgctaacggtgatttgctgttggaacagaaaatctgccaaagcttcgtgataaatattggtggcttcgatcacgcagtgaaaagtttcaccaaatgtattgagccattgcataagtgattgaaatccttccggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcaaagcaactctactttctctataaccccattatgaaggtactcgtaatggggttttcttttgcccatattctaatacaaggggcaaactacatttgccccaaaatgctctaaataaatgaagcggatcacttggcatccgtttcctaaatttgtgaaaagcgatattcaatggacgccaagcgtggcgtccctactggctctaggaatacttggataaaaatatcccatcacttgtaaagattagacaattatttcaaacgctctttcaaataacgatcataatcaggaatttcgatctcgacattttgctcaaacaagctagattgtaataagaaatcggcagatgcttggttgattgccacagggatattccagacggtcgcaatacgcattaaggctttaacatcagggtcgtgcggtgcggcattcatcggatcccagaagaaaatcagcatatcaattttcttttccgcaagtggacattgttatgctttaaataatttaagaataaattgtttatttttatatcaattattaaaatacaacgaagaaaatattatgcgtttaagagtaggaagtggacttccgaatattcagaaaaaaagctcttaaaagtttttctctgtcttatccgcaagatattagcgaacaacaaaaaatcgccgaaattctttcaatagcagatcaagagatcgaaacattacagcgtaaattggagtgtttgaagttggagaaaggggcgttgatgcagaggttgctgtagtagtataactatttgggagcttaactatggatattaaatgtataaattatctagaaaaccactatttctttaacgataatagtcacactatggatgctcacatctttaataaatgtgaatatgaaatactattgataattagagaaattgctgcggaactaggtgtaaaagacattattaccttagaaattttaccattagaagatggtgggttagttaggtggctaaaagctagatcatactctgatattatagcaaccttaactcttatcgttgctataattcctatagttctttctcaatttccaagtgaattagaaaagttagaagtagaaaaagcaaaattagagatacaattactaaagaaacaattatctgatttagatgaaaaaattaaggaacaaccagaagttgatgtggttgaaaaagtcactgaattagtagaatcttcatctcaatatataatgcaaaatccattaataagaaaacgtatttcaaattattacaagtctttagtagattatgaaaaaatcactaaggtcagctatatttcttatgataaaaataaatatcctataaattctcctaaatttgttcataaagataattttttatcatttatttttgaagcaaaagaaatacttgatatcgatgaaaatgcgagaatacatatttattcccctagtttagtaaaaggaaaacataagtggaaaggatattatgaaaaagctggcattgtaattgatttcagtatgttagataaagattttaaaaaatcagttgaaaatggagaagttgattttagaaatggctcgatgattgatggagtattacaaactaaaattaagtttgataaatttgataatgaggtgtcacgaacctattctattattaccgttttgaataaaatagacggaaatgtatttattgaaacgaaacaagggaaaaaatacagagaacataaaaaattcctagaaaatcaaggaacttttgactttttataaaaatatatgaatgctaaataaggtttttctaatgttagatttattgctactccccccctcgaaaaacacacctccaaacttccagccattttgcttttacacaatcttgtctggcagtatctttcccctaaacaagccttagcttatcgtggggggaagacggtgaatgtggtgttggacgtggtgttgcgggaggtgttgagccaacgttcgatttcctatcttgggcaagcgcgtgcgttgtcggcgaaggcggtggataatttggtagcggagctgactagcccgaagttaaacgaaagtttggtgggggcgaatgagcatttttataatcatctgttatacggcattaccgttaccaaatttattgacggcaagaaaatcagttgcactgtgccgattattgactgggaaaatcctgaaaacaatcagtttcattttaccgaagaatttagcgtggcaaatactaacggctcatcggtgcgtacgcccgatttagtctgttttgtcaatggcttgccactggtggtgattgaagccaaacgcccagacggcaaaccgaaaagtaccattgaagaaggcatttctcaacatttacgcaatcaacgccctaccgaaattccccacctttttgcctatgcccaactgttgttagccgttaatggttatgacggacgttacgccacttgtgcgacccctgccaaattttgggcggcgtggcgtgaagaagaacaatccgagttggaaataagccaactcaaaaatcttgctatttcagccgaaaatctgaccgctcttttaccaaaatctgacgttcaggcttggtatcaacagctcaccgctcagggaaaattagccgtaacagggcaagacagcttgctgattagcctgttacgcaaagaacgtttgtttgagatgatccgctatttcagtttgtttgatcgcaaatcacacagtcgtattgtcgcccgttatccgcaagtgtttggggtgaaacgcttaatcgatcgggtaatgtcgcaaagcgaaaaaggagcgagaaatggcggcgtgatttggcacaccacaggttcgggcaagtcgtttacgatggtctttttctcaaaagccttattgctccaccctgccctaaaacagtgccgaattatcgtggtaacggatcgggtggatttagaacatcagttgagcagcactttttataacagcggtgaactggcgaccaagcgagatcgtaaaaatgcaatggcaaccaccggcaagcgattagccgagcaaatcggttccggcaatgaacgcattattttttcgttaatgcagaaatttaacacggcgattaaccaagcggaatgttttaattcgagtgcgaatattattgtgttgattgatgaaggtcatcgcacccaaggcggagaaaatcatatggcaatgcggcgagccttgcctaatgcggcttttgttgcttttaccggcacgccgttgttaaaagacgatgaaaccacacaaaaatttggcaacatcattcacgcttatacgatgcaacgtgcagtggaagataaagcggtaacgccactgctttatgaagagcggatccctgaattgtcggtgaacgaacaggcgattgataactggtttgagcggatcaccaagtcgttaaatgaagggcaaaaagcggatttaaaacgtaaattctcgcgtaaagggcagatttatcaagctgatgaccgtattcatttaatcgctttagatattgcggaacatttggcgaataaaattccgcaaggcttaaaaggtcagctggcgtgcgaaagcaaagcgacagcaattcgttatcagcggtatttggacgagattgggctgtttgaaagtgcggtagtgatcagtccgcctgacagccgtgaaggaaatacgcagcttgacgaacaggcaagtgatgaagtggtgcgttggtgggcagccaacgtgtagggcgatgaagaacgttacacgcaacaagtgttaagtcgttttgccgatcctgacagtccgttgcgtttgctaattgtggtggataagttgctcacaggctttgacgagccgagcaatgcggtgttgtatattgataagccgttaaaacaacataaccttattcaagcaattgcacgggtaaaccgcttgcataaacaaaaagagtacgggctgttggtggattatcggggcattttaaaagagctggatacaacgattgccaaataccaagatttagccaaccgaacgtaaggcggttatgccattgaggatttagctaggctttatcgctcaatgcaaagcgaatatctacgtttgccgagtttgtatcaagcgctttgggcaatgtttgccgaggttgaaaataaaatggatcttgaacaacttcgccgccagcttattccaactatgcaactcgacccgacaagcggcctgtttttcgataaaaacagcaaaatacgcgatgatttttaccgtgctttaactgcctttaaccgctgtttacaggtggcattgcagtcggaaaccttttatcaagacaaaaactttaccgatgccgaccgcactttatataaaaacaccgtcgccttttttgcccaactacgccgtttggcacaacaggacgccggcgagcaagtggattatcgcgaatatgcccatcaagttgagcaattaatcgataagcacgttgttgccttaggcgtaaaagaagcagacggcatttatgcggtcaataaaatgggcaaaacggaatatcaaacgtggaacgacaccaaaacacgcaacgaagccaataaaattcgctctcgtattgctcgtagccttgagattgattttgacaacgatccttatgccaaagcccgtttttccgaattattgcaacaagccattgaagaagctgaagccttgttcgaccacccgataaaacagtatctgctgtttaaagaatttgaagaacaaatggcagaacgtaaattgcccgatattccagaccgctttggcggcaactatgcggcacaagcctatttcggcgtatttaaaacagttttacctgaaaccctatcgcaaggcgaagacttttgggttgatttggcatttgagatcgatcaggcggttttacgctgtttgagcgaacattccatcaaccttgaacaagtggaaaaagacattcgtaaacagttactgccgatgatatttaaaatctgccaagccaacggcagcggtatgttacaagccaaagagattgtcgaacggatagtacaaattgtgcgagttgggcgttcaaatggataagtttgatagcgttatcattccttatggcgaccaacattttaccgttcgcttggtcaagaataccaaatataaacggctacgcctaaccgtgcaacccacgggcgacatcattgcttatgcgccgccacaagcggtcagaaatgagctgattttttccatcagcaaacaaagtctgtggattgccgaccaattgcaatttttccaacaaaacccaccgcttgttgaacggcaatatatcagcggcgaaagccaccgctacctagggcgacaatatctgttaaaggtatatgaaacgccaaataaaccgaaccaagtccgtttatggcgtgggcagttggaagtgtctgtgcgagaaaaaacggcacgacaagttcaacaatgtttggataactggtatcgacaaaaagctaaacagatttttgccgaacgtttaaattggctgctacagcaaaccttttgggtcacaacaaaccctcacatccgtttacgcacaatgaaaacccgttggggaagttgctccgttcaaggctcactatgccttaacccccacctaatcaaagccccgaaagaatgcattgattatgtgattttgcacgaactctgccacttcgccgaacacaaccatagcgaacgtttttaccgcctaatggggcaagtgatgccacagtggaaggaagtgaagacgaggctggatagggtggtttaagggcaaggggtcaaatttcgaaaaaatttgcaaagctatttggggcacaagtgatttgcccctacgtctactctctctattcgagagctagtcaaacctgattgcatcgtttacacagatacttattttagctatgatgttcttgctgtaaatgagtttagtcactttcgcatcaatcacagcacgcattttgctgaaaatcataaccacattaacggaatcgagaatttttggaatcaagcaaaatgccatttacgcaaatttaatgctattcctaaagcacattttgagttctatttaaaggaatgtgaatgtcgttttagtcacagtgatataaaatctcaaatttccattttaaaataattggttaaaggggaagtccagttatctagtacagccccaatatttttagagttgtattctgattaaactccaataaatgcatttctgtgtaagtagggaaccccatgaaaatcagtcaaataaaaattaaaaattttcgtaagttaaaaaattgtattattaatctttctaataaagaaacgctatttgttggagcaaataatagcggtaaaacatctgctatgcatgcattgatgttttttctgagtaatgaatctaaaaaatttaaaataacagatttttcaattgattattggaaacaattagatgaaattggtaaatcctggctgcacgaagatgttagtaaccatattggttctgatattaatgaatggagaaagtattgtcctagcttatatgtgactttatctaattttatagagctagatttacccaaaattaaacatttaataccatctttgtcttgggatttaaattcatcattatatgtatcgcttatttatgagcctaaagatttaggaaagttgaaagctgattttattaaacatattaaacaaattaaagaagcttattcggaaagaattcctacaattttaccaacttcactaaaagaatttttaggagaaaatataacttcgtatttttctatcaatgcctatttatttgaagaaggcaatgagtcaaatttatatccattgcaaaatttcccttttgaaggaattttcaagttaagcataattcccgcacaacggaaatttgccgattcaactgatattgataataaaagtaataacttatccgatgaactaggtaaattttatgaaaatcacattgattttaagaaactcccatctattgatgatataaacacattactagccattcaagagcttcaaaatagaattacttctgaactaaatataaaatttcaagaaccattaagcaaattaaaaggtttaggatatccaagtgctaattatgatcccgatataaaacttgaaagctttattgataactcagatatattaaagcgacatacaaaggtaaaatttggcaatgatacaaacttagcattaccagaagaattaaatgggttaggttatcgaaatctgatctatatattttttaaattactagcattcaaatctgaatggcaaagagaaggaaaagcatccgaaattgagtatgatttacctattgaaccaattcatttagttctaattgaagaacctgaagcacatttacattctcaggttcaacaaatatttgttagaaaagcttatgaaattctgacacaagatgtatcagatttattttcaactcagcttattattagtacccattctagctatatcattcatgaaataggttttgaaaatctccattattttaaacgaattaataataaagatattctttgttcagaagccattgatttatctaatgtattcaataatagcaatatagaaaataaaaagtttgtttctcgttatttaagaacgatacattgtgatttattttttgcaaatgctattattttagtagaaggttctgcagagagaatgcttctaccatactttattcgttataatttccctgaattacattctagttacatttcaattcttgaggttaatggtgctcatgctcatcgatttaaaccattaattgaagcattaggtgttcctagtttagttcttacagatttagattctgttgaccaagaaggtaaaaaagttaatcctaaacgaggagaaggacaaaaatctagttgtgataatttaacctcttggctttctttgcctgatagaaacttagaaacagtattagattattctgatagtgaacaaattgtaaataattcatttatttcttatcaaaaagaaattcctattaattggcgtggaaaggaaaaaactgtcattccttatacctttgaagattctataatgtattccaatttagatctttttcaaaataaagaaaaaatgaaagaagcaacaggcatgttaaagaaaatgcatcaagctgcattagcacaaaatatagatgattgttgtattaaggcttttaatgcactaagtggagaaaaggctagaatggcattagatattttgtatatgtttgatcctgatgtcaacatatttaatacgccagattatatagaaacaggcttaacttggttaaaaaaagaattgggactagataatggagaatgtcatgaataatgtagataatgatatttactcttatgctacagcacagcctcctaaaagttttcttctttttgctggcgcgggatcaggaaaaacaagaacgttagtaactttgttgcaaaaaataaaagaagatcaaagaaataatctaacgaagaatggacaaagagtttgtgtaattacatttacaaatgcggcatgtgatgagataaaacacagactgaactacgatcaaacatttaatgtatctacaattcatagttttgcttgggatttaatcaaaaattttacaaatgatataaggagttatttaaaggaaaaattagaagaagatattattgagctaaatgataagataattaaagcaagaacgactaagtcaagagatagctatacaaaagataaagaaaagaatgagttacgcctagataacctaaaatatattcatcaatttatctatagcccaacagaaattttagttggtaaggatactctcaatcactcagaagttattggtatttgtgctgactttttaaaaaacaaccctttgatgcaagatattttagtcagccaatatcctattctatttattgatgagtgccaagatacgcaaaaagaattattaatttctttattggaaactcaaaaaagaaaaaaagattacttttgtctagggctatttggtgatctaatgcaaagaatctattctaatggttatgctgaattagtggaaaatcttcctagtgattgggaaaaaccatttaaagaagagaattatagatgtccaaaaagaattgttaaactgattaatgatattggtagttcattaaagaataatagatttataaaacaagaatctaaaaataatgatgaaggaatagtaagactatttattcttgataagaacactcctaataaattagagatagagcaaaaagttagagaagaaatggcatcaatatcttgcgatgaaacctggaaagatataaaaaatgttaagactctaatattagaacatgcaatggcagctaagagagctgggtttgatgcatttttctcaccattatctaaaaatgatataattagagataacctcctacaaaaaacaggtgaatctgttttatttctattaaaccaatttcttccactgattgaatatatacaaagtaatagaccatttgaaataatgaggatgttagaacgatattctctctgtatgaataaagataacatagtagaaaattttgattcttttaattctattattaaagatttttcttatagggtaagtgatgaatctagtttgaaagaattattactctatatttacgaatatgacatattagaattaccaaatgacataagaaatggattgcattttgaccaagaggccgatgaggaaaatagagcatttttatggaatcaagctttaaatgcaaaccttaaagaattgaaaaattactcttcatatattaaaggtgaagtaggctttggtactcatcaaggtgtaaaaggcttagaatttcctagagtaatggctatcttagatgacagcgagtctcaaggtttcttatttaaatataataaattactgggtacagaacctttaagcagtacggataacaaaaatatttcggaaggaaaagatagtgtcattacacgaactttaagattattttacgttatttgtagccgtgctgaggagtccttagctattgttgtttatagcaatgatccagctagattaaagcaagaagtcattagctcaggatggtttaatgaaggggaaattattgaaatatagtccatgattgaggaggaccctactcttgtatgtaatttatctattacacctaggcattttagagaatcccctataagcggtcaaatttcgaaaaaaatttgcaaagctatttggggcaaatgtgatttgcccctacgcttaatttctcgccctttcttccgctgtaaccgatgttaatttagctaatttcggggcgagccattctcgtagatcgtccatcagcgaataaaccacggacacaaacaccaaactcaacagcgtggaggcagttaagccgaaaatcacggcaacagccattggggcgcggaatgctgcacctgcaccgctggcaaatacggcagggaacatagctgcgaccattgcaatggtggtcattaaaatcgggcggacgcgttctgaacccgattgaattaaggcttgatgacgtgccattccttgttggcgtttttcgatgacaaaatccaccagcaaaatggagtttttggttacgatgccattaacatcaaaataccgatcacagaagacatatccaacgccgcatcgtaggcgagcaagcccactgctgctccgccgatggacagcggaagtgcggttaaaatggtaagcggttgcaagaagtccttgaacaacagcaccaacaccaacaataccatcaccacgccagcggccattgcaaagccgaattggctgaacatttcgtctatcatttccgcatcgcccgatgacggcacacgcacgctgtcaggcaggttttgcattatcggcagttcgttgatttgcgataatgcagtgccgatggtttgccctaatgctaaatccgcctccaccgcaatacggcgttcacggtcgaaacgttccaaacttgctgaaccggcgccaaattgaatatcggcaacggtactcaatggcaccgtgccaccattgctgctagctactcgcagttggcgaataactacttctggctgattgcgttcgtgttccgccagcgtaacccgaataggaatttggcgattttttgcaagatttcatcggcttgtgccagcgtactgcttggtggtaacgtaacatctaactggctcattcccgtgtcgcctttcggcacaaagcctgtgggcaactgtggcaaaatcagtaccgatgtcactaaaaacacgccgccgagcaataatgtggttttgcgaaaatgcaaggcttttgctaacagcgttaagtagccttgttttagcttgcttgaagaagttatcgcaaacgttttatcagcggtcggttgcaacaaataagccgccaacaaaggcgttgccaagcgagccaccagcaaggaactcaacactgccgccgcaacggtaatgccaaactgcccgaaatactgccctgtcataccgtcaataaaactcacaggtaaaaacaccgccacaatacttgccgtaatcgccagcaccgccaaaccaatggcatcggacgcatctaaagcggcaaggcaatcgctgccaccaacgttgcacgccaatttcgcaaaaacagccacaccaccaataccgtcaatgccgccccttccaacagtgtagaaatcgccacatcgtagttccctttggtggtattcaccgaattatgcacttccgttatctgaatatcgggataattggctgccaatgtttgcaatgcttgttgaacgcctttttccaccgccgtaaccgatgaaccttcggtaatggtcgaagtaatatgccgcaccccagccattcccgccaccgcatcttccacacggcgagtaacggtattttccaattcatctgctgacgcccccgtctgcgttaccgtaatattcaccatcggaaaccgcatatctggatccgcattaatcggcaagccttgaaaagcacgaataccaagcacagttaaaagcaaaaacaacacaataatcgggattgggtgacgaattgcccaagataaggttttgaagttcacaaaagtccttaaaattactaatttatgagaattttagtaaattttaagacttgttttaagtgaagttagagggaagaaagtggtggggttttaagagaaattttcaaatcactatattatgctgttgttatacaatatcatccgtaaggggagctttaaaataaaaccattgcattttgtagccaagtgattacaatactattcaaaggagaatttatgtacgtcatagaaactacgcttatttttgatgaatggcttgataatcttaaagatctaagggctaaaatgcagattgttacgcgtatccgccgtgctgaaaatgggaattttggcgatcataaaccgttgcccaacactggtggcgtaagtgaaatacgcttagatattggaaaaggttatcgcatttattacggtcagattggtgaaatcacttatattctcacaaatggaggcgataaaagtagccaacaagccgatatagaaaaagcaaaagcgttatttgcacagataaaacaacagaaaaaggaacaataatatgattgaaaccaaccgttttgatattgttaaatacctagatagcgatgaggcgattgccatctatttaactgaaattgcagaaacaggcgatagcaatgatttcattgttgcacttggtgatgtcgctcgagcaaaagggattgcagaaatcgcacaaaaaacaggtcttgctcgcgaaagcatttataaagctttaaccagtggatctaaaccacgctttgataccattatgcggattatgaatgcacttaatcttaaaccgcaatacgcaatcaatttaagctaatcaccacaaagcgaacaacacaagagagaagatttatcgtatttttcgtcaatttctccataaaaactgaccgcactttaactgattttgtgccaaagtgcggtcgacttttcagtttttatatcttcataaatctagaacatcataggctcatattctttggcatagtagacaaaatggttgctaaaaagtaaacggtggaatttgccaacatttttgccaatcacaaaatcttatagaaatccgaccgctcttttcaagttacctattacctcacaatcgtctcaacccgctctccttcattaatcaacgccccagccttttgcaccacttattcgccaacttccaatcctgataggatttcggctatgccttgattgacttcgcctaggctaatcaggcggcgttctatttgtttattgtgattgaccaccatcacaaaggcggttccatcggcgttaaaattgaccgcacttaacggcaaggtagtttgggcttgcatttcgggcagtttgattaaggctgtggtgggtgtgccgagagtgagttgagcggaggtttgcaactgaatacgcactttgcctgtacgacttgtctggtcgatttgggaagaaagcaaacgaatttgaccgcttgttgttttgtcaagcacttgaacttccgcctgcaagcccgttttgagcaaagataattcttccgcactggcttcaacggtagcctccaactcgccatttcatgcaagatgaaacaaggcgttgctgtccgttaaattgcccacttcggcttttttgcgttgatgacggctatcgtcaagctgtgcctgcacctgagcgatttccgcattcgccgcctgaaccgcctcacgagcggtacgcactttcgcctgttgttgctccaattcctgacggcttatggcatcgcttttcatcaaggtttgataacgtttcagcgtggctaaaacctgcccttttttgaccacatcgcccacttccacattaaccgtttgaatttgtagcccaagcaatgccgtcccaacagccacatcttctttcgccgtaattgagcccgaaagacgtagcgtctgtgttaatgtcgcaggttgagcctgaattacattcactttcattaatgctgtttcggttagttcgttggattgttcattgttttgctcttggcaagcggttaaaaataagcttggcaaagcgaataataaaatcaattttttcactttaaagtcttaaaatttaccagttatgcggcattgttagttattttcaagactaaatcaagtcatttttaagactgttttgttggctattaggataatagagatggtagccatcgtaggggaaaatcacatttaccccaaaaatcaagcggtcaatttcttgcaataaattgcaaaaaattgaccgcttacaatcagccgttaatcacttgtttggtggctgcgattttgatatcggcataacgtaccacatctttaatcaccagcttttgcacagcagaaataagggtttccataaaaccgtaatccatctctccgtttttgatcgggtaattaatgtacttattttgcactacattccaaccgccaagtttatttttgtatgaataaatttttaaatctgtcaccttattaatacacacaacgctaaataggtaatgctgtgacaaaaacggaacttttttattgctccatcgaatagcgtacgcatctgacaaaactgtaaattctcttgattgataataccctctgtagacatcgctatttgatggtaaagaaatcacattttttaatatagttgctcctttttgtggtgcataataatttaagccttggttttgaaaacttgatgttaaacaaggcaatacatattctccttgtgcttcttttggcaaatcaacagctttataatttaatttccttgtggatattctctcaaacaaatcgctcattttaaattcaccccaaaccactttaccattttcaaaatcggcaagagcctgttgttcagcagcggtaagcgtataatcttttaaacctgtaaccaataaatacgcctcgagctgcgagatgcggaacgcctcgagctgcgagatgaaattttccataaaatcaaagtcaatctgggcgagtttgtccgaattggcattgggttttatgggaagagataatttcacttcttttgctattttccaatgtcgagcatagcccaaatcgggaatttcttttttccaagaagagataataaataatagttgtcttaaactaactctttgcaaaggttttaaaacctttacattgtctaatatggaaaaacttttagtcgcaatattaaaagttcgtgtatggtctccaaataccacataaaattttctgctttcatcacagatatatgttggcatatctgtataacccaccaccccattattatccgaagaatacactggataattacctatttcaggcagctcacttttattttttatcttactaccactcacaacttgaaacaattcactgcaactatattccgcccatttaacctgttgcaattcttgcgttaaatgggcttctattttcccaaatgttcgttacttggggcttgttttttcaggatatttgctacttcccacgctaaatagtcgctcacggtctttttaaagtcatcaagcgttggtttggtatctatcggtgcggtttggttccagtctgcaccgtttttggggtctatggtattttcaaaatactctttttcgctaaacaacttcaatttagacttgccaaaacgcaccaaattgaccacttcttcatagcgtccacgggcgttgtcggtatctttcaggttgctgctggcttttttacggttggttcgggtatagccatcgttgctaaaatcaatgaattttaccatttcatcggcgtgatgtttttcacccactttaaacacataaatattggtctgtacgctggatttaccgataaataaatcaatcggcattttaatactggcaattaaggtatgtttttgcaaaatgcgttggttgatttcttttgccttaccactgcctgccgaattttgaatgataatcgccgcatagcctttgttcatcatatttaaagcggtttctacaaagttcattccgttacccaccgctgaataaggcggattgagaacaaaagcgtccgcagggaatttgtcatcggtattgccaaaaccatatttgccgtcaaaatcggtcagtgagttcttgttgatgatgtttgagctaccatcgcccatcataatcatattcaaaatagcaagcatatacacgctagaaagcaactccaagcctaacaactgttttgctttaatatgcgcttccttttgacgcaattcttcgggcgaatgaatagcctctttggcatctttgagcatttcgttcatcgcagcgaccaaaagcccggctgagcctgttgcaaagtcccaaacatagctgtctttatttacccgagctaatttaaccagcaaagttgccacataagacggtgttaaaactacatcattaagtttatcttgagtaaaaccaagccaagaatacatttcgttaaatagcttgcctgtaaaatcggtagttaagccgattttgtaataaatacccaaatcatcaacaattttggtgaatacccgcttaagctggctttcgccattttgcggtttgttaatgttatcggttaaaagcgtattagacaaagtgcggataattaaatcttttttgtcttgtggtaattgtttttcattaaaaaaggcgttgattttacgaataataatatcgccatctcgattgccttcttcttcagaagattttaaatcagatttttctaacggcttcactttgcctgccacgcccagtgtcgcaataatagaagcggcaaccagataaacacggtcgttttcgcccaagcctttttcattttggtaaatatcattgttgagtttggttaagctggtatcgatctctttttcacgcttttctttgagtttttctaattcttcaggtgaaatcgttagatgtttgatttgtgcaataaaatcatcaaaattttctttggcaaggaaagaaaaatcgctaaattcgccaactttttgccctacaccaagattggatttagacacataataaaccccgatttgatgacgaatattacctttctcgtctttttctcccgtcataccaatagcgataatgtcggtataactggtgtgatggagcaaggcattagcataatgcaccgcaccattcaccgcatagccgttgatgtgtttaaaattcggttcgttttttgctgtgcgattatctacattgccttcggcatctaatttgaccaacttgtcgccatagcctttgtattcaatcaaaatcgggtaatattcagtatcggtcgcctgtaacaacaatttggcatctggacgatttgctcccacaccaccatttttagaaaagtaatctttcaacgctttatcaatttcatcattcagcgtttcttgttctaatttgtagtctaattggtattttttcagccagccgttcgctaaatctgcaatattcggttcaatagattgttgttttgccattttcttgcctttctgagtaatcaattattcgatattatcttaaatttcaatgtattgtgcgatgtttttttgtgattttaaataacaaccgccagggcaaccacatatgttgtccatttttcaacctacacgccgagcaacagctcatctcgaaattcatctgaccaaccagcagcggtcaatttccctttcatactctgctttttcgggtgtaatcgagccaagttcaacgctaatcgatgcaagattgccagattttccgcaccccattcatcggtcacagcacattcgtcttctttatagaccatatctagcacccaatgggctttgttttccacttcccaatgccctcgcacgcacttcgccaacatttgaatatcagcatccaaactacggatataaaaaactttttcttgcgattctttgccattatctgaccgcttgcgacacacctccaacaccgattttatccccttccattcctccgctttgctcagccaatcactcactttcagcttacggtagtaacgctcatcaattcgacgacgttccgcatttacctcctcaaacgtctcaagcatttcggggcaatctcggctgattttgtgaaaatacgcctccatttccgactgaaattgacggtgatttttcttcaacggcatcacataatcccctttcttttcgatgattttctcggcaattttcttctgtgtattcatcgcatccaccgttataacggcattttttaagcaaaaactatcgataatttccatcaccgtctgctgctcattttgcttacccgaggattttttctgcgataaaatcaaaccacgagactggctccacaccgtcacactgtgcaaagcactttgggtttccggattgaaactatgacgaagtgtcttgccatcaatcgcaatcacctcacgtccttgttgtgtgcgtatctcattgataaaattaagaaaaacctcattaaatgcttgtggctcaatgcgttttattacacgagcgatagtatcatcgacaggaataccacactcaaaaggacgatattttcgcaaccaatccaaatgtaattcgccaaaaagtttgatttcagtccagctgtttgcccccgaaatcacggcactgatgacgagaaaaacgatgtctaaaaagtggtgtttttgattataggctcgtgggtcggataaattttcaaaaaaacgaaaaacgctcattttacaacctgatttgatacggataattaaggtgtattagatcataaatttgagaaagatgcgatcttgccctgtgagattgggtgttttgcaaaggttttgtgttgatattttaggttaatctatttatactgtaaaaagacatttaagtcggggtgctgccaaaagcggctgagaaatacccgtgaacctgatacagttaatactggcgtaggaaacttatgaatatcatcttatctatctctttgatgcacacgcaagctgcctgaatatcaggtagcttgcgtgtgtttttattttctgattgtttcttatcttgtttaactttgtcatcaaaatcaacggtatcttctcacattttcaggcagcctgaacataaactttcgcaggagaatatttttgatgaatccaaaaatcatttttttagatgctgttcgtgaacataatccattaattcacaatattaccaatttggtttcagcgcattttactgctaatggcttattagcattgggtgcctcgcccatgatggcagaaagtcctgatgaaatggcagaattggctaccatcagtagtgcggtggtactgaatttagggacaccgtctgacgaaaaagtctcggctatgttggcagcgggtatggcagcaaatcaagctggcgtgcctgtggtgcttgaccctgtggctgttggtgcaagccatttgcgtcaaaaaacagttgcgacattaacccaaaatattcaatttgccgctattcgtggtaatgctggcgaattggcatatttggctgatgttcaatgggctagcaaaggggtagatgcggggcaaggttcggggaatttagctgaaatcgctcaaaaagtcgctcaaaaatttaacaccatcgctgttttgagtggtgaacatgattttgttgccaatcatgaccgtgtgatgaaactgtctaatggtgtggcattgtttcccaaagtaacggctacggggtgtttattgagtgcaattgtgggtgcttttttggcggttgcgccgcgtgaattggcttttcaggcagcctgcgaagcgtgtacggtgtatgccatcgctggcgaattggcagccgtaggtttacaagccacgcagtcaggcacatttgcagtgcgtttattagacgcattagcagcgattgatgccactcaaaccgaacagttaatgaaagcagaatggattatctaggagaaaaaccatgactataccccaagttttaaccattgcaggctcggatagtggcggtggcgcaggtattcaagcagatttaaaaacctttcaaatgcgcggtgcatttggtactagcgtggtaacagcagttaccgctcaaaatacattgggcgtacatcatattcacatgatttcattggataatattgcagcgcaaattgaagcagtggcaacggatttcaccatttcggcatataaaattgggatgctgggtactgcagatgtgattgaatgcgtggcaaattcaattaaaaaacatcatttaggcacattggtattagaccctgtgatgattgccaaaggcggagaattattattgcaaaatcatgctattgaagccttaaaacgcgaattgttacctttagcggatatcattacccccaatttgcccgaagttactgcattaacaggggttcaggtaaacaatgatattgatgcccaatatgctgcgcaattattgcgtgatatgggcgtgaaaacagtcgtcattaaaggcggacatttagacaattccaacagcgcggtgtgccgagattgggtcttttcaggcaatgaaatgcacatattggatacacctagatttgccacacctcatacacatggcaccggttgcacattttcagcctgtattgcagcagaattggcaaaaggtatagatacattatcagccattcgcattgccaagcaagccatcagtgctgccatctcgcaaccgattggtgtgggcaaaggttgtggcgcagtaaatcattgggcaatatcggcttaattaaggaaaaaatctcatgtttcaacgtgaattattatccgtctattttgtggcaggtacgcaagattgtttgcatttaccaacaggttcacctgaacaaaaattattgtctacattggaaacggctttgcaagcaggcataacctgttatcaatttcgtgaaaaaggcgaatcggcattgcaagataaacaggcacaatggcagttagcacgtgattgccaagcattgtgtcggcaatatggcgtaccgtttgtgctgaataatgatgtggaaatggcagtaaaattgggagctgatggtgtccatattggacaaaaagatatggcagccatccaagccattcaattaacgcaaggcaagttatttttagggatttccaatagtagcttgcatgatttgcaaaatagtttcaggctgtctgaaattgattattgggcggtaggtgcgattttcaatactcaatctaaactggatgccatgcaaaacgtgggaattgatttgattcgtcaagccaaacagctcaatcccaatcaaccattggtcgcgattggcggtatttcggttgataatgttgcgagcatttgggcagcaggtgctgatggtgtggcagtgatttcagccattacacaagccgataatgtgatgcaaacggtgcagaaattaaagacaacatattgatgatgttaggggctgatgacaatattagccccgctcattcagcgagaattgcattatcatttgctaaaaagtgaaatggcgggcaggctttatcaaatggttgcggtgggtggcaatgtcgccaaaattgcccaagcaattgcttttttaaaggcaaatttcaggcaaaccttgaccatagattagtgtttcaggctatctgaaaagaaatgaaaaatttgcagattttttgcaaaattcgaccgcttgtagataagaaagccgtctgaaagtttgtcagacggcattattttagtccaaatatcgctccaactctctttccagttcctccctattcggcaaataaagctgatatttgctgacaaaaagctggttgtcgatactatccaacgcatattccaccaacagcttatctttatatgcacccaacacaatgccaatcggctcgttgtcgccgtctacgttttcttctttgcgaaaataattgagatacatattcatctgcccaatgtcttgatgattgacttcgccacgctttaaatcaatcaacacaaagcatttcaaaatgcggtggtaaaacaccaaatccacataaaaatgtttgccgccaagagaaatgcggtattgtcgcccgataaaggcaaaacctttgccgagttccagcagaaaatgttgcagattggaaatcagctgctcttccagctcattttcctgcatttgatgggcttgcggaatgttgagaaattccagcaccactggatctcgcaaaatatcttgcggacgtgcaatttcctgcccacgctccgccaatgccaacacaccgtctttgtctttacttaacgccaagcggtggaacagcatcgatttcatctgccgttttagctctcgcacgctccaattttctttttctgtctgtttggtgtaaaagccgatttctaacggattgtccgcttttaaaatctcaaagtaatgcgaccagcttaatttgtgagacagcgtctcacaatttggaaatgagagataaaatttccgcatatagtgcaaattagaacggctaaaacctgcaccatagcgatcttttaaatcttttgaaatacggttcaacaaatccgaaccatactccgccttatcttgcccattctgttcaaattccacaatatgccgaccgatcagccaataagtctgcaccaaaatggtattggcagtttgggcaacctgctcacgcccacggttaagcagcgtaccaatgtcggtaatcaggctttgataattctgcgtactgatattgttcatctttaagttccactgtgtggtttttcagttattcaatcataaacgacaaccagtatcaatactggataaaggctttattggtactttggaagtaagctcaaaaaataaaaatgccgtctgaaagttgatttcagacggcattatgttttaatcccagtgaaagatgattttcaaaccaactgcatcggcaaaattttgaatggatttgcgaagatctttcattgatagattatgataaagataaatatttctggttaattcggtggtatatttcattccattcgggcggaagctaggctcattaccaatacagtggttaccgcttggttttccatttaaacaaaactcttccactaattttcggtaacggctattttttaataaaaacaaaaagaattgtttttgattatctcgataacttttccctaaaattttatgaccttctaactcaataaaatactgtcctgtgctattttcttcatcggtaatagtggtttcaaaaatattgatatgtgccacttcgtccataatttcttgagctaaattccaaatgttatcggctttaattttacttgttttctcaatataagaacgattgcccacggtattattatctaattgaagttccgtttttttaaatgcttcaatcaatctcttttcaagataatccgtttgggatttatctaaatgcccatcttctcgcccaaagaaaataatttggttccaccaagatttattttcatcaagatgatgagcggctaagcgttcataaattttattacttgcttgcccaacataacgctgattttcgcctaataaaatataaattccggctttatttgcctcttccaaatattttaatgcttttaaatctgtgcgatcggcaatcactaaaaatgcaggttctttggtataaaccgtaatattatcttttgatcggtcgctgataatgactgtgtgcgtaaccataaattatcctatttttatatttttaaaattatttattgtaaatactgctattttctcttttcagatttgtactgatctgtcttaatgcccaaacaccttcaaaatgggctttgcgagggtagatctattgcgataataactgttaatcgtttgttactaatgaacaaaagtatttgatactaatggaaactattttatgctaaaaatagagagaacggcaaagtgtttgttagtgtcggacaggaatgtttgatactaaggctcgtggatgttttgtgcttgtcaaatatactattttgtacctagcacgcaaaatgcgtactaggttacgcatagttgaatggctttgccactctaattctcagtcccaaaggggctgaattatgcgtaacccagtacggctctgccgtgctgggtgtcaagcattgcatgttcagtgctaagggaggttgatttttcaaatcaccccatcaattcatcaactaattcctgcacgcttttcacacggtcaatcgcagaaataccattgcccaccgacacatagccatgctcaaaatccccttccagcatacccaaacgcatacccgtccccgcattcatcactttggcaatatcggcacgagttgcaccgttttcgctcatttcaaagcattttttggcgatttcggttggcaaagagcggtaataatacagctcggtgcggaacaataacaaatcattggcagttgattgaacaatccaatctttcactttttgattggctcggcactcatgcgtagcgataaatgccgcccccacccacacgccttctgcaccaagcataaacgcggtctgaaccgcttttttatcggcaataccaccagcgagcatcatcggcaaatccactttacccacaaattccgccaatacattaaaactgccaatttctttcatcggcaaggttccgccttcgtcaaaacccgtcagcaccaaaatatccacacctaacttttgagcttttaaagcgtctggcaaattcggattacccagacggcaaatgattttgatgcctgcctgtttgagtttggcgtaaatcgcttcgtccaaccaaccattatccagcaccacaggcacttgctcttcaatcaacaaatccaccatcagcggaatgagcgaaaagtcataagacaaaacaaacggcacgccaaaaggcttatccgtcaaggctttgactttgcgaatttcggcacgcatacggtctaatacatcttgattggacgttggattggtggtttgtcctgcgtgtggggctaaaaatcccaatccgccagcattagcaacgctcgccactaaatgtgcatcggtcagccacgacattggggcttggacgatggggtatttgatatttaaaatttgggcaatacgattgttttgcataatattttctctgatttaaaaaatggaataggcgtattttagattattgaaattgagaaaagaatagcgatttttgggaagttggttttcaaatatggaaattaactttcaggtaggctgaaaatattttgcaaaatttaaaaagaaaaacaccgcttgaaaattaaattcaaacggtgtttttaaattaactgacttttaattctgtccaagctcttttgatgatttcttgactggcttgtaatgctaaaaatgccaaaataaaagccacaattaaatcaggatattttgattgaaaaaaataaactgctataccagccaaaatcactgtcacattaccaatcgcatcattgcgagaacatacccatacacttcggacattactgtcgccatcacggaattttaataatatcaacaatgccgacacattcaccaataacgccaaaaatcccacaatactcatttcgctataactgggaatttccccataaaatgcacgataaatggttgtaattaaaataaataagccaaaaacgcccatcgttagtcccttaaccatagatgctttggcacggtaacttaatgccattggcaaaacaatcaaacttatcaaataattggcactatcgcccaagaaatccaagctgtccgacaacagcgaagttgaacccgatttaatccccattacaatttccacaaagaacattgataaatttaataccaagacaatccacaaggcttttttgtacttgggtgattgatgaatgggctgatttgaactgcgacaactttggcacgccataacaaactccgaaagatgattgaaatttgctataatataaactccgtagtcattacagggtcaagcacaatgtcaaaaatttttcaaattaaacaagccagtgaacaaacaggcgtgcatttggaaaccattcgttattatgaaaaacaaggtttaatcaagccaacttttcaagctaatggctaccgagtttttgatgaaaatcagctagaacaattacgctttattaaaacttgtcgcaatatcggtttctctttaaaagacattcaggtcttattggcattccaaacaactcccaatcatcaatgtgatgatgttgatgagttaacccaaaaacatttatcgcatatcaatgaacaaattaagcaattacaagaagttaaatcatttttggaacaaattattggttgtcaaaataaaaaaattgaaaattgtcaaatcattaaaagtattaaagataaaggataatgtttcagccagcctgaaaattattttgccaataaaaaaacaccgcttgaattgctccaagcggtgtctaaatctcattatttcacttcaaaatacgccattttatctttataaaatgagcctaaataataagtgttattcacaggcaatacggtagaaataccactaaaatcagccgtataagcgtattttaggttattcaaattgagaaaagaatggtgatttctgggaatttggttttcatttatggaaattaggttttgacaacctaaaaatatctaccctaaaactttccttttgaaaaatgtttttgataaccctattttcatttgaaaaaatgatatttaaccctattctttcctttgaaaaagtgtaaatcctgctgtaaaatagcctgaaattaataaaaaataacctattatgcaacgaaaaatccttcaatccctacaaaactggaaacaaaatccaaaccgtaaacctttgattattcaaggagctaggcaagttggcaaaacttgggcgatgaaacacttcggtgagcaatcgtttgagcaagttgcctatatcaactttgataataaccctagaatgaaaacgctattttcaggcgattacgacatcaatcgcttgattttaggtttaaaaattgaaagcggtgtggatattcaagcccacaatacgctgattatttttgatgaagtgcaagaagtgccacaagcgttgtcatcactaaaatatttttatgaaaacgcccccgagttttatattgtatcggcggggtcgttgttgggtgtgtctttacatcatcaggtgtcttttcctgtgggcaaggtggattttttaccgctttatcctatggattttcatgaatttttgctggcggtgggcaaacaagatttagtggaattattaaatctaaaagattggtcgctgatttcggcaatgaaaagccgttatattgagctacttcgtcaatattattttgtcggcggaatgccggaagcggtgaaagtgtttatagaaacgcaaaatgttgatgccgttcgccaagtgcaaaaaaatttattgatggcgtacgagcaggatttttctaagcatattcgtgatggacaaacagtgcaaaaagtgcggtcaatttggcatgccattcccgaacaacttgccaaagaaaataagaaattcatctatgccaatttacaaaaaggggctagaagcaaagactatgaaatcgctttgcaatggctaaaagacagcggtttggtgcatagcgtcccacgcattaaaaaaccgcatttgcctttatccgcttatcaagataatgcgtttaaattgtatggattggatattggtttattgtcagctcaaagtcagttggacgccagtgtgttgctagacggtagtcgtatttttagcgaatttaaaggcgcattgaccgaacaatatgttttgcaacaactgattgccaatcaagacaaccctgtattttattgggcaacggaaaaaggcacggcagaagtggattttgttgtacaacaaaaacaagcggtcattcccattgaagtgaaagccgaagagaatttaaaagccaaaagtttgaaagtctatgtggagcaattccagcctgaatgcgcttttcgtttttccatagcggattatcgggagcaggattggttggtgaatgtgccgttgtatgaggtattgctatttggggaataaagttaagaggctaaactgcttcctaattaaaatggaataagcgtattttaggttattgaatttgataaatgaatggcgaattttgggaagttgattttcatttatggaaactcgtaaaatacagtcaattcatgataaaatatacctaatttttaaatctaaaataccgtctttaattacaaggataactatactatggtgcttgaatatcaatttgatgataagaaaaatcaaatttttgctccacttctagacaaatggttaaaatacacaccagaagaagaggttcgccaaaaatttatttgcactttggttaatgaatatggttatttacttaatcaaatggcacaggaattaaccttaaccaattcatctcgtggtacagggagagccagagcagatattgtcatttggaagagcgcccaagataaaaatgagaatagaattgccagcattgtcattgaatgcaaatcagacaatgtaaccattgctccagaagattattatcagggcttgaattatgctacttgggcaggagcagacttttttgtaacacataatagtaaggaaactcgctattttcaagtttataaatacaaacttcccaagcatttgggtaaagagcttgccaatattccaactgctaaacaattgttgaatgacaatgccgtcaaacaagtcttaaccgaagaaaaagtctttgaaaaagatgagtttgctaaacttttacatcaatgtcataacattataagaaataacgataaactttcaccagaagcctgttttgatgaaattagtaaaattttatttaccaaaattgtttttgagcgagaaaataaaaataataatggtgtaacacagattttttccaaaaaagaatttgaaaatcaggaacaaaattttattaaaaatattcgcccctatttgcaaggagaagataagaataccgattatttacaatttatttttagaagaaccaaagaaaattatactaaagaaacactattttctgatgacgatgtcattaaaattcgtcgtgaaagttttctggcgattgtagaaaaattggaagtttataatttatctaaaacatcagacgatgttaaaggcattgcgtttgaaaaatttttgggctcaacatttcgtggcgaattaggtcaattttttacgccacgcactgtcgtggagtttatgactgagattttagacccacaagaaaaggaaaccgtctgcgacccttgctgtggttctggtggttttttaattaatgcatttgaatatatacgtgaaaaaatcattacagatattgaacagcaaaaagaagagattaaattacaatattttaatgatgattatgaaaaagcaaatgaaagccaaaaattaacaatagaaaatcaagtagatgaattatttaaacaattaaataatgaattgaacttggataatataaatagtcgtttatatcatctgtcgcataattgcatttttggaacggatgccaatccacgaatggcacgagtttcaaaaatgaatatgattatgcacggagatgggcacggtggcgtacatcataatgatggcttgctgaatatcaatggtatttttgaagaacgatttgatgttattttaaccaatccgccttttggttctagcgtttccaaagatttaaaactaactgccgaagatgacttaaccgcaaaatcccattatgctgattgggttacaaagtaccctaattatgaaatgattagtaatgcacgcaaacaggatattgaaaatggcgtggcaatcattgataaatttgatgttgggcaatttagcagtttaaccgaagtgttatttatggaacgctgtttaaaattattaaaaaaaggcggacgaatgggcattgtattgcctgaaggtgtattaaataacgccaatttacaaaaagttcgtgaatattttgaaggtaaagccaaaatattgcttatcgtttctttaccgtctgatgtgtttaaatccgcaaaagccacggttaagccaagcattgtctttatgaaacgctttactgataatgaagagtttttatatcagcaaattaaagaacaagttacacaagaaattgcaaacaaatatcagacaaaaattgctgaattaacggcaattttagataaaaaagcttcaacattaaaagcacctaaaaatgccagcgatgaagaaaaatcccaaatcaaatctgaaaataaacgattgcaagatgaattaaaagcccaaaaagcccaagccaagactgatttaaaacagctggaaattcaaattcaatccgaaatccgtcaaaacatcaaagaaaaatttgattatgaaattgcccttgctgaaatttctgacgctggcattgatagcacaggcaagccaacgaatgccaatcaattaccaattttaaaagcagagtttgagcaatatcgcaagcaaaatcagctttgggaaaatggggtggtgtaatggattatcaatttttgcatttacttaacttttctgatttaaaaaattggagtgttcaatttttattgggaatccaatcgtcatataatgacaattatccacttgttccattaggtaattttctgatacgcaacaaaaaacctgttgaaattcaatatgataaagaatataaacgagtaaccattaaaataaataatggcggtgtatttttgcgtgatatagaaattggtaaaaatattggtacaaaaaatcaatttgaaattaaagaaagtcaatttattttatctaaaattgatgcaagaaatggggcttttggtattgctaacagtaatgtagatggagcaattattacaggtaatttttgggcttatgatgtggattattccaaaattgacccaatttatttatctttaattactacaaccaattattttattaaattttgtcaaaaaagtagtgttggaacaaccaatcgtaattatttgcaagaagagttatttttggcagaacaaatccccctacctgatattgatattcaaaaatccttagtatctgcctatcaagaaaaaatcagacaggctgaaattttgaaaaatcaagccgagcaaatagatattgaaattgagcaatatttatttgaaagtctcggtattcaaattgagaaaaccatatcgcaacaaaatcaaggtattttgcagtttatggcatttaaagagttgaaaaaatggagtgtaagcaatacagataatattgcggctgaaacagtatttttatcaaaaaaatataataatgaacctattacaaattatttttttgttaatccaaccacaattactccaaaagataaagagattagttttatcccaatggcaaatatctctgatgagcatggtgaaattatcagcaaagagcgtaaaaaattacaaaataattatacccgctttcaagaaaatgatttgctttgggcaaaaattacaccttgtatgcaaaatggaaaatcagcagtagcgaatgatttattaaatggctttggttttggttcaacggaatttcacattttgcggaataaaaatagtatttttgatattcgtttattacatttgttattgagaagtaaaaggttattaacaacagcaatgacttattttactgggtcagcaggtcagcaacgagtgcctaaaacttttttagaaaatttgaccttaccaatacttcctaatgatgaacagattgcaataattaatcatatttacaatctaaaaaacgcacaaaaagaagcccaaattcaagcaaatgaattacgcaatcaagccattcttgattttgaacaggctatttttttgtagggacatacaatgaacctaaacgccttatccctattcgtctctgtcgttcaagacggaagtctctccaaagcatcataacggctgaatgtaccgattgccaccattagccgtcaaatcacagaattggaaaaatcgctcaatattcaactctttgaccgaaaaaaatcaggcgttaagccgacaatggcagggcaaaaactttatgagcaagtgtatcaaaacattgataatttattgcaagtagaaaaagcattctctgaacatcaagaaattagcggaacattacgcatttccacctttacaggattggaagaagtttgggcgtggctcgatgaatttggcgcaaaatatcccaaagtgagcattcattgccaagtaaccgaccgagtattggatttggtggaagataatattgattttgcgtttcggacaggggatttgcataccgataatgcagtggcacgtttggtgctgacggcaaaagccaaatgcgtggcacatccgcatttattggcacaatacggcacaccgatgacacctgatgatttggtgcgttttccttgtgtcggttttgccaaagccgagcaaaaagagttgataatttcattagaaaataaggtattgaaattgccttatgtgtttgcgtccaacgatgtgtatgctatcgcttatttaattcaacaagggcgtggcgtggggaatttacctgaaacgattgccaatcgcttgattaatgaatatggcttggtggaagtgttgcacgattacccgatgcggacttatcctgtgcatttgttgtatttgaaacatcgttatccgtcttcggtgatgcgtgcgtttttggattttgtgatggaaaaagtgggggttgtggctggttaaaaacaagcggtggagttttgaaagcaatttgtaaaatctcgtcaaaaacccaccgctcttttacaaccgtttcaaataactttctaacgattgaacgtccccatataacaactggcttggcacaatatgcaaccgttcgtctttttccacaatcaactgcggtacgccttgcacgccacaattcttggcaagttgttgtccgaattgaagacgctgttctaacgctacttttgtcgattgttcgctaagcaacggcacagattggctaagattgagcttatgcaacacctgttcaaccaccgtcaaatctgcattatccaaaccgtccacataacgtgctttctgcaacgctaccaacaccgtaagctctttttcaggggcaatttgttgcaccgccgttaaagccagcaaactgtttgccgaattaaactcgccctgcccttgcaatacgttttccaaatacgcctgactaaacggctgatcggtcaatttttcaattcgttggtcgttactccacgcatagcgagcaaaatctgcgtccattttccgaccgcattggtaaaacaaacctgttggcgtaagtgtaagcggatagatttcattgagtttttgcaaggttgctgatgccccgtagcaccaaccgcaaaggggatcgaataagtagtagattttcattttgttttcctattttctgcaccataaaaatcattgaagtgtggtgcatttaagttggcaatctgcaatactacaaacttaaccttaacttaattacccttttacccaatgtacaaatacaccaaactcacccagcaccttaaacatttaattgaaacaggcgagttgaaaccgcacgagaaattgccgtctttgcgagatcagacagcattcggggctgagtttgatgatggtattaaacgcctatcaagggttagaggctcagggggtgatttattcggtgcaaaagagcggttattttgttgcacctttttacccgtcttctcgtccgcacgccaacagtgaaattaggttgaacaaacaagtcgagattaattcgttggtgtttcgttatctgaaatccattacggatattgagcctttggggtcgccttttccgaaccacgattatctcaatccgcccaaattgctacaaattctaagccagcttagccgtgatagaacgcagattgagccacagcctgtgttgtcgggcaatgtggaattgcgtaaattaatcgcacaacgttaccgcttgcaaggtattcctacgcaagccgatgatattgtgattacgtccagctgtttagacgcactgaacctttcgctacaagccttaacgcaacagggcgattatattttattacagcagacggtattttatggggcgtggcagattgcggaaaagttaggcttaaatgtcgtcaccttgaccgaccacccaagcggttttgtggcgtttgagcaagccttacagcgttatcccatcaaggtttgttggtttatgctgaactgccataatccactggggtttaccgtcagccccgaaatcaaacagcggattggggaattgttagctcaatatcaagtgcatttaattgaaaacgatgtgtatcaagagctttattatcggggtgaaaagcccttgccgatgaaggcgtttgatgcacaaaactgggtgttgcattgttcttctttttctaaaattttaggggcaaacttccgtatcggctgggttcacgcagggcaatttgccgataaaatccaacatttgcaactgatgagtaccatttctgctaacgctttaattcaacaagccttggtagaatttatctctaatcaccactacgagaaacatctgcgacaccttcgccgtcatttagaaaaaaacaaaaagcagtgtttggattacctacgtcagcacttgcctgcaagttgtcctatcgaacaccacagcagcggctatttcctttggatacacctgcccgaacatttggatagtatgcggatttatcaacagtttctcgaagaaaaaatcagcgttagcccaagtgagctttttaccttgcctacttcgcagcataaagggattagggttaattgttcttatgcttggaaccaagagatcgaacaggcgttaggggttttggtgagggtgttagcaaaatagcggttacttcatagaaactttttgcacctgtttcattatgcccgtgaatatttgatcccgtacattttcatctatctgtttgggtagtgttgttgctacgctatcaatggtttcttgcactgtatcgcaaatttgctctatcacttgtttcatatcacttgagctaaatccgacaaacttagctgtggcatagaaatgttcagcgtaaattttattccaatgccatttttttcctttttgcgtgctacgcaagctcattgccatttgtaattcactgtgatgccaaccttttccgcctaacattggataagaagaaagtacgtcatacactggggataagtgataacgcccttgtttttcaatggcgagagaaaagtttttagcgtgtccatcaatggctgccagtagccaaaacagaaattgagtttgcataaattgacggcgatcgttggaattactggagtagagcaacttattcatcatatccccaataccaattccaccatcgctttcatatttttgcgttggcgataagccgaatgcctgacagaaatcttcgtaaggtaaacgtaaaaaataactgccatcttgactaagacggcgatcaaaacgttcaacagctaatgcccgtatatcgttcatttccaataattcaacgtttgcggaagggatattgaaagcagaaaataatctcaaacagacgagttcgttatctacactttttgacagatcaagcaggtgtttaggggtacgaatttctcccataggcaatttgaaaatatgcgttgtcggggtcaatccgtgtggtaatttccatttgccgttatgccaaagcagagctgtcttttcttgtgcaccagcaatagaaattctgaagtcctgattattatcaatcataccaagtgggacattgtattgataactttgtagaattttcgccatttcactctcgtttaattctgtggcttgaattattcgatgattaggaatttgttcatcttcccctaaaagagtaatagcacccgcagcatcgcgaccaattttagcaagtaagtcaaaaggttgttgtgtttcagcattaaatcttgtcgcaattcttgctcgaatttgaggattatcgggcagtaaattatcaaagaaattaatcacttctttgccttgatatgttgctctttgcaggggcatagaaagggaaatcgggcgagctaatggggaatttagccaactttcagcataggtaaaatggtgggaacccgataaagtgcggtcaaaatacccaaccatttcgccattcattaatactcgtaatcgcattaccattcatcgttcccctctgttttttcaggacgaggttggatatgtagttcatagcctaaacctgaaagtaacttgaataatgtttcaatagtggctttatcggtttttttctcaaaggtggaaatcgtggcttgtcttaaagctacttgatttgctatttgcatttgagaaagctttttttgcttacgaatatcgcgtaggctatttccaagcatatctggtgtcgtgattaacatatttcttccaaatttattttatactaagtgaagtataattcatgaaatatacgctgtaaagtataactatgatttttatactttatagcgtatatagataatctgaaataatgtatagaagtgttgggtatttattccaataactttttaatgattcatcaacgaaaaccgcaaaaactcgacaaaatgatccgcccagtgcatttcgtggtggatttcatttgccataatttttagacgaatattatcgagaggatgtcccgtgcggattagtgcttggtaataatgcaacgtacagtcaatataagcctgattcatatttgaaataaaatgtgaatccacttcatcgccttcattcgttcccacttgaataaacactttgcttgagcagttgagtgggtgtgtatgaataaattccataaaggcaggttcactaaaccacgaggcaagagaaaatacgcctaaatgcccgaatacttcaggatattccgctcccatataagcagtgataataccgcccattgagctacctgcaagtagggtatgatcacgatcacgtttagttcggtaatgttgatcgataaaaggcttaactgtttcaaccacccaacgcccatacgccattccatatcctccagcattttgggtttcaggggtagagcctgtgtctgttcgccacggaccatattcatcaagacgatcagggcctgcattgtcaataccaacaatgatcatctttggaaattctttgtgatttttaatcgtcggaatcactttccaagaatgtcccgaataagactctttgctataaaaaatattttgtccgtcgtgcatatataacacgggataatgacctgcttcttcacgataccctttgggtaaaagcacacggattcggcgttgttggttgagataaggtacatttagataatgctctcgcatttcaaggaaataatattgaagaggatctcgcattgtaaaacttcttggataaaacagataatcgggtcaagtatatcacaaatcatctttcccctaaaaatttccctatcatttgtaaaaatccgttaaaatctcaccgcttatcattatttagagaaaaccaatgttaaaccaagtttcaaacagtttgctgttacctagcggacttcaattatccgatctgacgaaagtgttggatcatttttctagccgtcaaatcgactatgctgatctctattttcaatttagccaagatgagagttggtcgttagaagatagcattatcaaagaaggcggtttttatatcgaccgtggtgtcggtgtgcgtgcggtgtcaggggaaaaaacaggctttgcttatgccgatcaaatttcgcttagccagcttgagcaatgtgcaatggctgctcgtagtatcacgcaagaaagcggtcggttgttggtaaaacctttcaaagaaacgaccgctatcaaacgctatgcctcgatcaatccccttgataccttaagtcgtgaacagaaagttgaactattacatttagtcgataaagtggcgagagccgaagatcctcgtgtaattcaagtgaacgcaaatctgtctgccgtatatgaagaaatgttagtgtctgcaacggacggcactttagccgcggatattcgcccgttagtacgtttatctatttcggtattagtagaacagaacggtaaacgtgagcgaggcagtgcaggggctggtggacgctttggcttggaatggttcttagcaacacactatacaggcgacagtcgtgccgtctaccttgctaaagaagcagtgcgacaagcggttgtgaatttaggtgcggtcgctgcacctgctggctcaatgccgattgtgctgggtgctggctggccagggattttactgcacgaagcggttggacacggtttagaaggcgattttaatcgcaaagaatcatcaatgttcacaggcagaatcggcgaacttgtgacatcaccactttgtaccattgtcgatgacggtactgtgccaaatatgcgaggttcgattaccgttgatgatgaaggtgtgccttcacaacgtaatgtattgattgaaaacggaattttaaaaggctatatgcaagataaactcaacgctcgtttaatgggcgttgccccaacgggtaatggtcgccgtgaatcttatgctcatttaccaatgcctcgtatgactaatacctatatgacagaaggcaatcacgagttcgacgagatgatcgagtcggtggaatttggtttatacgcccctcacttcagtggtggacaagtagatattacctcaggcaaatttgtgttctctacgtccgaagcctatttaatcgaaaaaggcaaaatcaccaaaccagtcactggcgcaaccttaatcagcagtggtatcgaagcaatgcaacaggtgtcaatggttggtaaaaaaatggaactggatttaggtatcggcacttgcggtaaagaagggcaatctgtacctgttggcgttgggcaacctacggtgaagttggataagattactgtggggggaagggggtagatgtgctttatttttgcttactagttgaaattatcacagattgaatttatggtatttttttagaatgattctaaaaatagatgacaaggttatagtgcaaagtaataacgtacttgaaaatccttgtaacactcaaaaaataataagattcacaagaaatttgtgaaaagatcgtggcaacaccagcagaaaatgttagaattgcgcgatttataattgaatattcacttttgtaataaattttaggttgtatatggctaaagaaattcaaaacataaccctggataaagtagaaaagggtgtcaaaagtaaaggtataaataatgtattatgggtattttcaatttcattattaacaatagcagctattggaaatacctattttgcagaatacttttcattaattgttcgtatattgctgttagttgtgctatgtgttgctgcattgggtattgctgcaatgactaaccaaggtcagcaatcaattgattttatcaaagattcgcgccaagaattacgtaaaattatttggccaaatcgccaagaaacgacgcaaacaactttaatggttgtcgcaatgtgcgttgtagtggcattagcattatggggtatcgactctattattgtgttaattattgatttcctaacaaatttgagattctaatatgagcgagattgaaatagtcgaacaagaaaaagatacaagcaaaatgcgttggtttgtattacaagcattttcgggctttgaagcccgtgttgcaatgactcttcgtgagtatattaaattgcataatatgcaagaccaatttggtgaggtgctcgttcccacagaagaggtggttgagaatgttggtggacgccgtcgtaaaacagaacgcaaatttttcccaggttatgtgttagttcaaatggaaatgaatgatgatacgtggcatctggtaaaaagcgtgccgcgtgtaatgggctttatcggaggtactgcggataagcctgcaccaatttctcagcgtgaagcagagcgtatccttaaccgtgttcaagaaacggcggataaaccacgtcacagaacagagttccacccaggtgaagaagttcgtgttaaagaaggtcctttttcagattttacaggcactgtggaagaggtggattatgaaaaaggtcgtgtcaaagtgtccgtttccatttttggtcgagcaacgcctgttgaacttgaatttaatcaggtagagaagcaaaatacttaataaatattattgcaataagtaaaggaagcctatcgatttttgagcctctcccacaatttgtgtaaatacctgtttctgagataatacattcagacacaggtattttattatgaacgaaaaacaacttcacgccttggcagcggaagaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcatgaccgtgacggcacctttgaaccgcaacttatcaagaaaaaccaaacccgcatcacaggaatggatgagcagattattgccttatatgccaagtggttaagtaatcaggaaatcgttgaaatgttcaaagaactctatgatgcggatgtatcaaccagcctgatttctcgcgttaccgacgcggtgaaagagcgcgtaatggcatggcaaaatcgcccacttgatgcggtttatccaattgtttacctagattgtatcgtagtttcagctttgcattgtgcatttagtgcgtaacagcttgaaattcgtttcgtggaaagattacaaagccgtcactgcatatttaaagcaggtttatcaagcccctacgccgtaatgaattatgtaattccgcttattgcgattttattagcgagtttaaatgtgagggttgagtatttgagaaagtagcttagttttataactaagctactttttaaataacgtttaagagaacaagataggattatttacgacactgattcaaaatatctaattctttattataggttgaaagtgataagttcatatccatcattcctatcacagaatgaaaataattgtcgtgagaataggtttttgttttgcattttcttctagagttgtaaacataaaacaagggtttttcccttgcctttttacaaaaaatccgtataatctggccgcttgttctctcttttttgaacaagtttcgcaccctcacctcgaacgagggttttcttttttactatcattaaacttttagaggacggttatggtaaccattcgtttatctcgtggcggagctaaaaaacgcccattctatcaaatcgttgtcgctgacagccgtagcccacgcgacggtcgtttcgtcgagcgtatcggtttcttcaaccctatcgcaactggtaacgcagaacgtttacgtttagacgttgctaaagtagatgcttgggttgctaaaggtgcatcactttctgatcgtgttgcagtattagtgaaagaagcgcgtcaagcagcttaattccacaaattaaataagtaggtgaatatgagcgagcaaaaaattgaagttgtcggaaaattaggttcaacctatggtatccgtggctggctacgcctttattcatcgacagaatatcctgaaagcattttcgattatcagccgtggttcttaaaaattaaaggacagtggcaacaagttgaactcgaaagttggcgttatcacaacaatgatttgattgtgaaattaaaaggcacagaagaccgtgaaacagcacagctattaaccaatgccgagatcggtgtggatttagccgtgtttccagaattggaagaaggggattattattggcacgatttgatcggttgccaagtggtaaaccttgaaggttatgcaatgggaactgtgaccgaaatgatggaaacaggttcaaatgatgtgttggtggtaaaagctagcagtaaagatgctttcggtaagcaagaacgtttaatcccgttcttatatgaacaagtagttaaaagagtagatctcgccactaaaacaattacagtggattgggacgctggtttctaacctcaggtatgcagtgagctttagcagtcgcatttcgtaggtcaaaatatgtggattggtattatttcccttttccccgaaatgtttaaagcaattactgattttggggtaacaggtagagcagtaaaacaaaatctcttacaagtgcagtgttggaatccccgagatttcacacacgacaaacataaaacggtggacgaccgcccttatggtggtgggccgggtatgttgatgatggtgcaaccgcttcgtgatgcaattcgtgaagcaaaagcaaccgcttgtaaagaagacggtgtagaatctaaagtaatttatctctcaccgcaaggacgtaaactcgatcaagctggtgtacaaacgctggcaacaaatcaaaaattgattttggtttgtgggcgttatgaaggcattgatgagcgattgatccaaactgaaatagatgaagaatggtcaatcggtgattacgttctcacgggggggaacttcctgcaatgacgttaattgacgctgttgcacgatttatccctggggtattaggcaaacaggcttcagcgttggaagactctttcgcagaaggtttattggactgcccgcattatacccgccctgaagtattagatggtttacctgtaccgcaagtgctgatgtcgggtcaccacgagcaaattcgcaaatggcgattagaacagtcgctagaacgaacgtggttaagacgccctgagctattggatagcctagctctgactgacgaacaacgcgtgttgttgaataacataaagaaacgacacaaatcagttaattctaggacatagaaggtttattaaaatgagtaacatcatcaaacaaatcgaacaagaacagttaaaacaaaacgtacctagcttccgtccaggtgacacattagaagttaaggtatgggtagtagaaggtagtaaaaaacgtttgcaagcgttcgaaggcgtggttattgcaattcgtaaccgtggcttgcattcagcattcaccttacgcaaagtttcaaatggcgtgggcgttgagcgtgtattccaaactcactcacctgtaattgacagcattgctgttaaacgtaaaggtgcggtacgtaaagctaaactttactacttacgtgagcgttcaggtaaatctgcacgtatcaaagagcgtcttggcgaataattttcgcttatgcgttgatgcaaaaagaaagccttggggaaacccaaggcttttgttttttcatgacttccttgttgttttacatctaaaacagcataatggtacttattctattcaataaggcaaatttatgatcaataaagatactcaactttgtatgtcgatatcgggcagaccaggcaacactggcacttatttccataactatctttatcaaaaactcggtttaaactttgtttataaagcatttaccaccaaagatattgaacacgcagtcaaaggcgtgagagccttaggtattcgggggtgtgcggtttctatgccgtttaaggaagcctgtatgccgtttttagatgaaattgatgcatctgcaaaagcgattgaatcggtcaatacgattgtcaataccaatggctatttgaaagcctataacaccgactatattgcgattgagaaattaattgcaaaatatcagctcgatccaaccgcttgtgtgattgtgcaaggcagtggcggtatggcaaaagccgttgttgccgcatttaaacattcaggttttacgaatttgaaagtctatgctcgtaatcaagacacaggaaaatatctcgcagaactttacggctatcaatatatcaatagtcttgaaaatcaacaggcggacattttagtcaatgtcactccgattggtatgaagggcggaaaagaagagtttgacttagccttccccgaaatgatgattcaacaggctcaaactgcttttgatgtggtggcaatgccagccgaaacacctttgattcagtatgcgaaagctcaaggcaaacaggtgatttctggtgcagaagtgatgacattacaagcagttgagcaatttgtgctttatacggcgattcgtccaagtgatgcgttaatcgcagaagcggcggctttttctagatcgaatcaataaaggcataatagacaaaattgaacgctatcctgtaataaacatctttttatgttttgataactcaatggcaaaccacttttttagaaagtaaatccatcaggactaaaataccaaattcacgatcaaagaaggtcgtatccacaataatatttaaataacgtgatagtagtggatttaatgctattttaggggctttcgagatactttgaatagtcctgataattcaaaaaagtggctcaaagccttatattacaatatcttaatctaccctttataatactttgtctactatacatcgatgggacaaagttcaaccatcggccaacgtggtttgacactcacggataaatccgtctgttcgccattttttaaacgcaagaaacctgcataggcaatcattgcaccattatcggtacaaaattgtgggcgagggtaaaagacttcaccgccgatctgcttcattaattcggataaatcgtgacgaagttgtttatttgcactcacaccgcctgcgatcactaaacgtttatagcccgtttgttgcaacgctctacggcatttgataatcaatgtttcaatcactgcttgttggaacgcataggcaatatcgcaacgggtctgttgatctaattcgcctttctcattcaaattcgcattaatcgtatttgccgcaaaggttttcaagcccgaaaagctgaaatctaagcctgggcggtccgtcattggacgtggaaaggtaaaacgatttggcgtgccagtttcagcaagtttagctaacgctgccccccctgggtaatctaaaccgagcaattttgcagttttatcaaaggcttcccccgcagcatcatcaatagattcccccaacaattcatattcacccacattttttacatcgactagctgagtgtgtccccccgaaacaagtaaggcgacaaaaggaaactcaggggcgttttcttctaacattggtgcgagcaaatgcccttccatatggtgaacccctaaagctggaacgttccacgcataagctaaagatcgtgcaatggttgagccgaccaataacgccccaacaagtcctgggcctgccgtataagcaacgccatcaatatccgaagcggtgagattagcttcttttaatgcttcttgaataagtggcaatgttttacggatatgatcacgagaagctagctctggcacaacaccaccgtagtcagcgtgcatttcgatttggctataaagttggtttgcgactaatcccttggcttcatcataaattgccacgccagtttcatcacaagaagtttcaataccgagaattttcattattgttattggtttaagtaattaagatagtgcttattataatggaatatcaacaattttgctgagaatgtaatgaaatgattttgtctgttgcataatcagacgaatttctgtagaatctcgcccgttttgctctctttagatagagcctataaaaagaaatcatatcttttgcaagcggtatgatcgtagcttaaacttactagaggaatagtactattaaacctgtaaaacgtgttcagacaaatcgcgcacatcgtcttaacgaagaaatccgcgtgaaagaagttcgcttaaccgatcaaaacggtgagcaacttggtatcgtatcgattcaagaagcattagcgaaagctgaagaagctgagttagacttagttgaaattagcccaaatgctgaaccaccagtttgccgtattatgaactacggtaagttcatctacgaaaaagagaaagctgccaaagagcagaagaaaaaacagaaagttgtacaagtgaaggaaattaaattccgtccgggtacagacgaaggcgactatcaggtaaaactacgcagcctgattcgctttttggaagatggcgacaaagccaaaatcacagttcgcttccgtggacgtgaaatggctcaccaagaaattggtatggacgtgctagaacgtgttaaaaacgatttagcggaaattgccgtagtagagtctgccccaggcaaactcgaaggtcgccaagttgtaatggtactagcacctaaaaagaaatagtccattaccttgagatgtaattagtgcttccaagtaatattggcaacaatattcgcctaattactgtttattaacataaacaatgcggagttattttaacaatgcctaaaattaaaacagtacgtggtgctgcgaagcgtttcaaaaaaacagcttctggcggtttcaaacgtaaacaatctcacttacgtcacattttgactaagaaaacaactaaacgtaaacgtcacttacgtcacaaatcaatggtagcgaaagcagaccaagttttagtagtagcgtgcttaccatacgcataagcgtaaattaagtgcaacgtacgattagttaatttttagtttaataatgtcaaagcgttaatttacgcttaaatagtaggagatttaataatggctcgtgtaaaacgtggtgttattgcaagagcacgccataagaaagttcttaaggctgctaaaggttattatggtgcacgttcacgcgtgtatcgcgttgctttccaagcagtagttaaagctgcacaatatgcttaccgtgaccgtcgtcaacgtaaacgtcaattccgtcaattatggattgcacgtatcaacgcggcagctcgtcaaaacggtttatcatacagcaaattcatcaatggcttgaaaaaagcgtctgttgaaatcgatcgtaagatccttgctgatatcgcagtatttgacaaagtggctttcgcagcattagttgctaaagcaaaatctgctctttaattttaaagaatagataaataaggacgctttcaggcgtcctttttcttatacttacatgatgagggattatatgcaaagtagatataagaagtccagaatagcagcatcttactgaagatgttgcaatcagcttcaattaacctaaaatcatagccatctttaggtaagtttttatatggctttagtcaatataaaagtacgatttctctctatttggagaacaaaaaatatgaaaaaatgggcagtggttttatctgcggcaactcttgcctttggtagtcatcacatcatggcgaaggaagggaatacggtttatctctatacatggtctgaatatgtaccagagggattgcttgacgattttacaaaacaaacagggattaaagttattgtttctagccttgaatcgaatgaaacaatgtatgcaaaactaaaaacaatggggaaaaatcaaagttatgatgtaattgcccccaccagctattttgtttctaaaatggcacgtgaaggaatgttgaaagagttagatcatagcaaattgcctgtattaagtgagcttgatccacaaatgcttgatcgtccttttgataaaggcaataaatactcggtaccacaactttttggggcaacggggattgcatacaatacggaaacccaagatcctgcaaattttcaatcttgggcagatttatggaaaccagagtttaaagatgcattacagttgttagatgatcctcgtgaggcatttaatatagcgttattaaaaatggggcaggatccgaatactcaagaccctgcgattttaaaagcagcgtatgaagaattattgaaattacgtccaaatattttggcttttaattctgataatccctcaagctcatttatttctggtgaagtagaaatcggtactctttggaatggttctgtacgaattgccaaaaatgaaggtgctaaaatcaatatggtttatcctaaagaaggcacaccgctttggattgataacttagcaattcctgcaacttcgcaaaatccggaaggggcttacaagctgattaactatatgctttcagctcccgtcgctgcaaaattgacaaaagctatcggttatccaacagcaaataaagtggcattagcacagttaccaaaagatttggttgaagatcctgctgtttttattcgttctgaagttattgagaaaagcccttggcaagttgatgtaggcgatgcgattgaactttatgagaaatattatcaagacctgaaaacagcgaaataaatagtcaaggttgcaaacagtacaaataaaattggcatagtagacaaaatagttgctgattcgtcaaaactataccaagtggacaaaacagttgctaatatgtagaagatcagacttgatcttctacagctaatgaagaccctatcccaaattctgtgtaaacacccatttcaacttaacggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatatcagccggataatcaaaaaatgtggcaatatttgcccagttatcttcccagcctttcgccacaagcgggtattttgcctgccatttttgcgaaagtgcggtcagattttcacgagcttgtgcttccgtcgaggcctgataaacctgctttaaatctgcagtgacggctttgtaatctttccacgaaacgaatttcaagctgttacgcactaaatgcacaatgcaaagctgaaactacgatacaatctaggtaaacaattggataaaccgcatcaagtgggcgattttgccatgccattacgcgctctttcacggcgtcggtaacgcgagaaatcaggctggttgatacatccgcatcatagagttctttgaacatttcaacgatttcctgattatttaaccctttggcatataaggcaataatctgctcatccattcctgtgatgcgggtttggtttttcttgataagttgcggttcaaaggtgccgtcacggtcacgaggcgtctcaatttctatctcaccttcatcacaaatgacggtcttagatgtgtaaccgttatgtgcatttttaccttttctaggctgatgcttttcataaccaagatggtcggtcagttcaccatttaacgcagcctcttccgctgccaaggcgtgaagttgtttttcgttcataataaaatacctgtgtctgaatgtattatctcagaaacaggtatttacacaaattgtgggagaggctctacctagttgaacaatcatacttagcaagtctttatatttaagaatgatattaaaaatattctctcgcttacctcctagtaaattgcttaatttatatttgccatatgccatcgatccctccataaaaaagcagtaattagacgattactgctcagttacatgtaaaattatgctacttcaacgccactcgtgcattcctaaaaatccgcatccaagccccatcttccgtccagtcttctggataccaagagttgctcactgcacgataaactcgttcagggtgtggcatcataatcgccactcttccgtccacattagaaatagcagtaataccgtttaccgagccgttcgggttggctgggtaaacttcggttgggttgccgttgttgtcgatgtattgggcgataaccaagttctgtttttgtagattttcaagctgatctgaccgcttaaattccacctgtccttcaccgtgggaaacggcaatcggcatatgtgagcctgccattccgctgaaccagagtgagttggtatcgttgattttcaccagtcccacacgagcttcaaaacgttcggatttattacgcacgaagcgtggccagttttctgtacctgggataatttccgctaagtttgacaccatttggcaaccgttacacacgccaagggctaaagtgttcgggttggcgaagaattggctgaattgatcgcgtagcattgggttgaataggatcgatttcgcccagccaccgcctgcaccaagtacatcgccgtaagagaagccaccacaagcaactaacgcattgaaatctttaagatttcttctgccagccattaagtcgctcatatgtacatcaatcgcattgaagcctgcacggtcgaaggctgccgccatttcgtaatggctgtttacgccctgttcacgcaagatagcgatgcttggttttacgccacggttgataaacggtgcagcaatatcttcattgacatcataggttaagaatgcagataaccctttgttatttgggtcttttttggttgcaaattcttggtcggcacattcagggttatctcgcaagcgttgcatttggtgtgtaagttctgcccaaattccacgcaattcagagcgtttttcgctgagtaatttgcgtgtaccactggtaatttcaaacagatcgccttccgttgctgagccgatgtctttggtaatgtgtagtaagttgtgagctttcaacacatcacgcactgcatttaagtcgctctctttgatttgaataacggcaccgagttcttcgttaaataacaccgctaaatcgttgtcgcctaatgcggtgatgtgagccgatacgccacagttgcctgcaaacgccatttccgcaagggtggtgattaagccaccgtctgaacggtcgtggtaagcgagtaatttatcatcagcaactaaggcttgcattgcgttgaagaagtttttcaaggtttctacattcaccacatccgcaggtttatcgccaagttgtttgtaaacctgtgctaacgccgttgcacctaagcggtttttgccttcgcctaaatcgagtaacaataagcgagttgtgcctttatcggtgcgaagttgtggagtcacggttttacgcacatcttccacacgggcgaaagccgaaattacgagagaaagtggcgcagttaccgctttttgctcgccgttctcttcccaagtggtacgcattgacattgagtctttacccacaggaatagtaatgccaagtgtagggcaaagctcttcgcccactgctttcactgcttcatataagccagcatcttcgcctgtgtgacctgccgccgacatccagtttgccgagagtttaatgcgtttaatatcgccaatattggttgcagcaatgttggtaatgctttctgctactgctaagcgagcagatgccccgaagtcaagtaaggcaactggcgcacgttcgcccattgacattgcttcaccgtgatagctgtctaaacttgcggtggttacggcacagtcggcaacaggaatttgccacgggccgaccatctgatcgcgagctaccattgcggttactgagcggtcgccgatagtaattaagaaggttttttctgcgactactggcaagcgtaacacacggtggaaggcttctttaagctgaatttcttcctgtgcaagcggtgggttttgcacggtttttgacgaaacctgacggtgcattttcggcgttttgccaagtagcacgttcattggtaaatcaatcgggttattgtcaaaatgatcgtcgtgcagggttaaatgtttttcttcggtcgcttcgccgatcactgcataaggcgcacgctcacgttggcaaagtgcttcaaataatggcaatttatccgccgcaaccgctaacacataacgctcttgcgactcgttacaccaaatttcaagcggtgacattcctttctcatcacacaaaattttgcgtaaatcgaacttaccgccacgatcgccgtcgtggactaattctggcattgcgttcgataaaccgccagcacccacgtcgtgaataaataaaatcgggttctcatcgcctaactgccagcaacggtcgatcacttcttggcaacggcgttccatttctgggttttcacgttgaacggaagcaaaatctaaatcttctttagatttgcctgacgccattgacgaagccgcaccaccgcctaaaccgatattcattgcagggccgccaagtacaattaatttcgccccaacaggaatttcgcctttttgaacgtgttcggcacgaatgttaccgataccgcctgcgagcataatcggcttgtgataaccacgaacttcttcaccaccaaaactgtttactttttcttcataggtacgaaaataaccaagtaatgcagggcgaccaaattcattgttaaatgctgccccgccaagtgggccttcgatcataatatctaacgcagaagcgatacggttcggcttagaaagcggattttcccacggctgttcaaagtttgggatcaccaagttagacaccgagaagcctgtcaaacctgcttttggttttgcaccacggccagtcgccccttcatcacggatttcgccgcctgaacctgtcgctgctcctgggaatggtgaaatggctgtcgggtggttgtgggtttctactttcattaaaatatgcgcatcttcttgatgatagcgatattgcccgtcttgatcagggaaccaacgaccgactttagaaccttccattaccgccgcattatctttataggcagaaagcacataatctggcgttttctcgaaggtgtttttaatcattttgaacagcgatttctcttgtttttcgccgtcaatcgtccagtctgcgttgaaaattttatggcggcaatgctctgagttcgtctgtgcgaacatataaagctcaatgtcgtgcggattgcggtttaacgccgtgaaattttccaccaaataatcaatttcatcttctgccaacgccaaacctaattccacgtttgccacttctaaggctttgcgaccaccgtttaaaatatccaccgtcgtaaacggcttcggttcgtgctgggcaaacagttggctcgcttggttttcatcggttaaaacggtttctaacatacggtcgtgcaacaagccttttagggttgccaactctgcttcatttaacgcttgttcaaactcgaaatagtacgctaaaccacgctcaatgcggtttaccgctgataagccacagttatgggcaatatctgtcgcttttgacgaccacgaagaaatcgtgccaatacgtggagttacaatcaaacaaaagccggttggctcgtgttccgcaagggttggaccataatgcaacaactcttggattttttttgtttcatcggctacaagcggtcggtttagctcaacaaaatgcaaatattcggcatagaccgatttaacaggcagttgatgttgctcgaatttttgttgaagttggtttaaacgaaagtcagataaggcaggtgagccacgaaaggtttgtacagtcattgggcagttccgttaatgatagaaaacaaaattgaaggcattataacggattacgcaaacgtttgcattttaaaaattcagaaagtttttctcattttatatttggaagggatagtctaacgaaacagtatcgcacaattggagtaacaaaaatagcactcatctagacaatatgccttcttctgttaatttatttcgtacaacctatacttgaatagtattcaaaggctataagggaatagcaaatccccgccttttaagacggggatatttattagtagcttgaatttataataacttcctctccatatccgccagcctgagggaatggcgtataagttgaacttgtggtacgcaatacacgaataccacgaatgccagcctctttagcggcgagaatatcatcatcgctatcgccgtagtgtaactgaatattatgttttaaaatccctgcggctttattgtattttgtttttaatttatcttgaccgtgtccgcccataaaattaacaggttgcatattttttataccaaaggttttttcaagtaatggggtgacttgatcgtccttacctgcagttcttcctgtgataaagaaaatctgatcgccacgctcttgatgcatattaatgagatcttgggcgacctgtttcggaatagagtatttatcacaaccagcattgatttcgtcccagaaatcttgatttttgagatagctataatcattcggtgaatacttctgcttaccatagtagaagcaaccgctacttgctaatacagtatcatcaatatcaaaactcacattcatcggggctttgccttttaagctctctttaatttgctcaatagaaacccaatgaattggggcttgctgttgctctgctaaacgtgtgttaaatccggcttgagtataaggctctttagaggcagcttgagcagaaagtgcaacaaacatatacgctaacaaagctgtacgtaaaaaaatagatttcattatatatactccttttataagtgaacagtaattgagctaaaactcagatgaattttaattttcattctattctaaataaagtcaaaatactttaattaacggattgatataaaacaaattatagttcttttaaatttaaattgttaagatcgttttcacaataggttatagagaacataatatgaaaactgcaatattttatttaacaaatgatggacaaacaaaaaaaatttctgactatcttgcgaaggagctacaacaagagacacaagttttctccttacgagacttttctctttggtctgtagaaacattagaacaatttgattgtattgttattggcgcatcgattcgatatggacattttgacccagtattggaacaatttattgatcgatattatgagctactaaatagaaaaaaatctgttttttttagtgtcaatttaactgctcgtaaaataactcgtaatacaccttatacgaatacatatacacgtaaattgctagacaaaattctatggaaaccaaatatcgctgaagtatttgctggagcattactctatcctcgctataatttttttgataaaaccatgattcgctttattatgaaaataacgaaaggtgatacagatactagcagagagtatgaatatacagattggcagcaggttagtgaattagctcaacgaatcagaaagttatcatagtttatccgaatgatgaatcaatacaaaccgttcccaaagctgttcattagtttcaatatgctcaggatcggtgatgatacagttgttgatcggacacactttttggcaggtcggcgtttcgtaatgtccaacacactccgtgcaaagatcgggatcgatgacataaatttcatcgcccattgagatcgcttgattaggacactcaggctcgcacatatcgcagttggtacatttgtgggtaatcaataacgccataatttgttaaatgaggaataatttggaagcgagattataccgaatagtgcaaaagtagaaagtctttatacataattttgcaatttgttatgtaaatcttaccgcttgactatacatttttaaatgacaaaaaggtcgatttcgcctatcattctgtctatcaatgtgaggacgaacttatgacaaattttgcttatcttcaacaaaaacgtaaacagttaaagctaaaagtaaatgatgtttgtgagcaagcaggggtaactagagcctattttaatcaattagtgtcggggaaaattaaaaatccaagtgcgacaaaattaggtgcgttgcataaagtgttgaatatcgttgaggaacaaaatcaacgagtaggcgtaatttttggtaagttctatccagtgcatacggggcatattaatatgatttatgaagcctttagtaaggtggatatgctacacgttattgtttgtaccgatactgaacgtgatttacaactgttccgtgatagtaaaatgaaacgtatgccaacgaatgaagatcgtttgcgttggatgcaacagatttttaaatatcagcaaaaacagattttcattcatcatttggttgaagatggtattcctagctatccaaacggctgggagggctgggtggaacgtgtcaaagagctatttgctgaaaaacatattcagccaacattagtctttagcagtgagattcaagataaagaaccttacgagaaatacttaaatttggaagtgcatttagtcgatcctgaacgtaactcatttaatgtatcagcgacaaagatccgcaacaatccgttccaatactggcgttttattccaaaagaggtgcgtccattctttgtgaaaactatcgctattttaggtggtgaaagtagcggaaaaactgttctagtcagcaaacttgctaatgtatttaatacgacatcggcgtgggaatacgggcgagaatttgtctttgaacaacttggcggtgatgaacaggcaatgcagtattcagactatccacaaatggcattagggcataagcgttatgttgattatgcaatgaagcacgcacacaaagtggcgatcattgatacggattacattactactcaagcattctgtattcaatatgaaggcaaacctcacccattcttagattcgatgattaaagaatatccttttgatgtcactattttattatcaaataacactaaatgggttgatgatggtctgcgtagtttaggttcacaaaaacaacgccaacgcttccagcagttactcaaaaaattgttagaaaaatataacgtaccttatattgaaattgaatcgccaagttatttagatcgttataatcaaaccaaagcagtgattgaagcgatcttaaatgaagaatccatagcattaacttttaaaaaccaaaacgagaagagcgaatgatactttttgcgggcgatcctcacggtagctacgcccacctttacccctttgttcaggaacgtgagaacgtagcgttagtgattttaggggatttgcaattaaccacgactgcagagttggataagctggctcaacactgcgatatttggtttattcacggtaaccacgacagtaaaacggttgctgcgtatgatgctatttggggaactgcttggaaagaacgaaatcttcacggacgcgttatcaatatacaaggcacaaaaattgcaggactagggggcgtttttagagggcatatctggatgcctcctcaccgcccaatgttctttgatcctatccattattgccaatatagtccacaagagcgtatttggcgaggtggtgtaccactgcgtcaccgtacctcaatttttccttcagatgtggaaggtttagaaacgcaaaaagcagatattttaattacccacgaagctcctcgcccacacccacaaggttttgcagtgattaatcaactagctcgaaaaatgggcgtgaagaagatttttcacggacatcaccacgataattttgattatcgtctaattaatcgtaataaggcctgtgaaatttttaatatcggttttagaagtttagcagatattcaaggcaactatttgctaattggcatagatgatcgggataaataaaattttattagcggtcagtttttgtcaatagtttgcaaatcttaatataacccatctccgtcggttgtgatctctgactaaatcagcgaaaatagccaccatttttgaaaaagaaaacgagaatagaatgtcattaaataattaccctcaagaagtaaataaacgcagaacttttgcgattatttctcaccccgatgctggtaaaacgaccatcaccgaaaaagtgttactttacggaaacgccattcaaaccgcaggttcggtaaaaggtaaaggctcacaagcgcacgctaaatccgactggatggaaatggaaaagcaacgtgggatttcgattaccacctccgtaatgcagttcccttacaatgattgcttagtcaatctactcgacacaccggggcacgaagacttctcggaagatacctatcgtaccttaacggcggtagacagttgtttgatggtgatcgacagtgcaaaaggggttgaggaacgtaccatcaaattgatggaagtaactcgcttgcgtgatacgccgattttaacctttatgaacaagctcgaccgcgatattcgtgatccgatggaattgttagacgaagttgagagcgtgttgaagattaactgtgcgccgatcacgtggccgattggttgcggtaagttgttcaaaggcgtttatcatctctataaagacgaaacctatctctaccaaacagggcaagggcataccattcaggaagtgcgtattgtcaaagggctaaataatccagagttagatcaaactgtgggcgatgatttggctcagcaactgcgtgacgaattagaactggtgcaaggggcaagccacgaatttgaactagacgccttcttaaacggcgaattaacccctgttttcttcggtacggcattaggtaactttggggttgatcacttcttagatggcttaaccgaatgggcgcccgctccgcaagcccgtgagtctgatttacgcaaagtagaagcaagcgaagaaaaattcagtggctttgtgttcaaaattcaagcgaatatggatccaaaacaccgagaccgtgttgcctttatgcgtgtggtatcgggcaaatatgaaaaaggaatgaagctcaagcacgtccgtatcggcaaagatgtgatcatctccgatgctttaacctttatggcaggcgaccgctcccatgcagaagaagcctacgcaggcgatattatcggcttacacaatcacggtacgatccaaatcggcgatacctttacgcaaggcgaaaacttgaaatttaccggtattccgaacttcgcccctgaattgttccgccgcatccgcctaaaagatccgcttaagcagaaacagttgcttaaaggcttggtacaactgtcggaagaaggtgcggtgcaagtgttccgtccattgatgaataacgacttaatcgttggcgcggtcggtgtgcttcagtttgatgtggtcgtttcacgccttaaaaccgaatataacgtggaagcaatctacgaaaccgtcaatgtagcgacagcacgttgggtggaatgcaacgatgccaagaagtttgaagaatttaaacgcaaaaacgagcagaatttagccttagacggtggcgataacttaacctatatcgccccaacaatggttaatctcaacttggctcaagagcgttatccggatgtggagttctttaaaacaagagaacattaattgccctctccctccgaaaatcctgcggattttctccaccctctcccgtaaacgagagaggggaaaaataagatacagaatagaagaataaatatgagtgaacaaatctacggtattcacgccgttaaatcctttttagatgttgcacccgaacgattaatcgaagtgtttgtactaaaaggtcgtgaagataaacgattaaccccattactcaaggaattacagcgtttaggcattcgagtgcaacaggtcaatcgtcaagcactcgataacaaagtgcaaggcgaagtacatcaagggattatcgccaaagtcattcaagctaaagagctaaatgaaagcgatcttgaccaaattttagatcgcaaagcaaatccgtttttattgatcttagacggagtgaccgatccccataacttaggggcttgtttgcgtactgctgatgccgcaggggttgatgtcgttattgtaccaaaagacaaatcagcacagctcacttcaacagctcgcaaagtggcttgcggtgcagcagaaaccgtgccacttattcgagtgacaaatcttgcccgtacaatgcgtgagttacaagaacgcaatatctggatcgtcggcacagctggcgaagcgacagaaagtctgtatcaggtgaaattaacaggatcgattgcgttagtgatgggggcagaaggagacggaatgcgtcgtcttacccgtgaacattgtgatcaactggtgagtattccaatggcaggatcggtatcgtcgttaaatgtatccgtggcgaccggggtttgtctgtttgagattgtaagacagaagttattatagtcgccttaatcctttttatgaaaataggtggtgcagtagataaaatgggcggtttttgttgttgtaatagacaaaacaattgctaaaaagtggcttaaagtcttatagtacaaggctttaagccctcttttttgaaatatgaacaaaaaactgcccattttgccaaagtcagaaaataaagaaacatgatatacaaaataatactcaacgttatttttgtaatgaatgttataaaacgtttatcttaaaatctaaattagattcaattaaaatttggactgattacacatccggaaaacaaacctatcaacaacttgccgaaaaatatcattgttcggttagaactattcaaagatatattgataaagtccctaaaacagctttaaaactaccttcaaatcgatacctaaacatcattatggatacaacgtttttctgtcgttattttggcgtattagtgctaatggattctaattcaaataatgtgatttcccattactttgtgcgaaccgaaaaagatatttactacaaacttgccctgaataggttaagggaaaaaggctatataattcaatcgattacctgtgatggtagacgtggtttgatgaaagatttatttaatacaccagtacaaatgtgtcaatttcatatggtagcgattgtgattcgaaaattaagaaaaaagcaccaatcacaagcgggtaaagaattaaaaataattgcaaaaacactcacaagaagctcaaaaatgaattttatcggcgattacattcttggtttataaaacatcaagattttttaaaagaaaggagtgataaagcgaatgaaaaagactattttccttataaacatagcaatgtaagaagtgcttatgccagtttaaagcattatatttttacctatgaaaaacattctgaattaaatatagaaaagacgacaaatcgtttagaggggttatttagtgaacttaagcgaaaattaaataatcacaatggattaactaaaaaacgtaagatgttgtttatacaggattttttaaataaaaagagttgctaagaataattaaaatattcattagcaaccactttgtcatataagcatagtttttgacgaattaacaaccattttatctactatgcccttaagataacaatctaatcttcttaaactaaaaatagattatttgatgattttcacaacaacaccagcaccaacggtacgaccaccttcacggatagcgaaacgtaaaccttcgtccattgcgattgggtgaattaagcttactgtcattttgatgttatcgccaggcattaccatctctacgccttctggtaattcgatagtaccagttacgtcagttgtacggaagtagaactgtggacgatagcctttgaagaatggagtatgacgaccaccttcttcttttgataatacgtaaacttctgattcgaagtctgtgtgtggagtgatagaacccggtttagctaatacttgaccacgttcgatttcttcacgtttggtaccacgtaataatgcaccaacgttctcacccgcacgaccttcgtctaataatttacggaacatctcaacaccagttacagttgttttagttgtatccttgataccaacgatttcaacctcttcacctgctttaatgataccacgctcaacacgacctgttactactgtaccacgacctgaaattgagaatacgtcttcgattggtaataagaaaggtttatcaatcgcacgctctggctctggaatgtagttgtctaagtggtttgctaattcaagaattttctcttcccactctggcacgccgtttaacgcttgtaacgctgaaccacgcacgattggtgtgtcatcacctgggaagtcatattgtgaaagaagttcacgaacttccatctcaactaattctaataactcttcatcgtcaaccatatcgcatttgtttaagaatacgatgatgtatggaacacctacttggcgacctaataagatgtgctcacgagtttgtggcattggaccatctgttgctgcaactactaagattgcgccgtccatttgtgccgcaccagtaatcatatttttaacatagtccgcgtgtcctgggcagtcaacgtgtgcatagtgacgagttgctgtgttgtactcaacgtgtgaagtgttgatggtaataccacgcgctttctcttctggtgcgttgtcgatttggtcaaacgcacgtgcagcaccaccgaattttttcgcaagaacggttgtgattgctgctgttaaggttgttttaccgtggtcaacgtgaccgattgtacctacgtttacgtggactttatcgccacgattaaattgttctttagccattgtaaagtttcctttgttgatgaaatcccatagcacactatgtgctatggagttttaaaaagttaaaaattattttttacgcgcttcgataactgctgctgcaacgcttgttggagcttcagcatattttaacggttccattgagtatgatgcacgaccttgagtttgtgaacgtaagtctgttgcataaccaaacatctctgaaagtggaacttcagcattgattttaacaacgaattcgttcgcttcttggccgtttaccatagcacgacgacggcttaagtcaccgataacgtcccccacataatctggtggagtttcaacctccactttcataattggctcaagtagaactgggtttgctttagcgaacgctgctttgaatgctaatgacgctgctaatttgaacgctaattctgatgagtcaacatcgtggtatgaaccgaagtgtaaacgtacacctaaatccactactgggtagcccgctaatggaccagatttaagttgttcttggatacctttatcaaccgcagggatatattcaccagggattacaccgcctttgatttcgttcacgaactcgtatcctggaccttctggatctaatggatataagtcgataacaacgtgaccatattgaccacgaccacctgattgttttgcatgtttaccttcaacatcattaacacgagtacggatagtttcacggtaagatacttgtggtttaccgatgtttgcttccaccttgaactcacgtttcatacggtcaacgatgatgtctaagtgtaactcacccatacctgaaatgatggtttcgcctgactcttcatctgtgtgaacacggaatgaagggtcttcttgtgctaaacgacctaatgctaagcccattttctcttggtcagctttagtttttggttctaccgcaacagagattactggctctgggaattccatacgctcaagaatgattggtgcttcttgcgcacataatgtatcacctgtacccacatcttttaagccgattgctgcagcgatgtcgcctgcacgaacttctttgatttcatcacgtttgtttgcgtgcatctgtacgatacgaccgaaacgctcacgtttttgttttacagagttataaactgtatcaccagagttaattacacctgagtacacacggaagaaggttaagttacctacgaatgggtcagttgcaattttgaatgctaatgaagagaatggctcatcatcgcttgcgtgacgctcgcctggtgtaccatcttcattgataccttcgattgctggaatgtctgttggtgctggtaagtagtcgattaccgcatcaagcattgcttgaacacctttgtttttgaatgcagaaccacagcaaactgggattatttcacctgaaagtacgcgttgacgtaatgcagatttaatttcttcttcagttaattcttcacctgcgaagaatttttccattaactcttctgaagcttctgctgctgcttctacaaggttgttacgccattcttcacagtcagcaagcatttctgctggaacatcttcataagtgaacgtcataccttggtcagcttcattccagttgatcgctttcattttgataaggtcaactacgcctttgaagttttcttcagcaccgattggaagttgaagcggaacagagttaccacctaaacgagttttgatttgttcaacaacgcgtaggaagtttgcaccagtacggtccattttgtttacgaacgcaatacgtggaacttggtatttgttagcttgacgccatacagtttcagattgtggttgaacaccaccaactgcacagtaaaccattaccgcaccgtcaagaacacgcattgaacgttctacttcgattgtgaagtcaacgtgtccaggagtatcgataacgttgatacggtgttgtggatattgttgcgacataccagaccagaacgctgttgttgcagctgaggtgattgtgataccacgctcttgttcttgttccatccagtccatcgtcgctgcaccatcgtgtacttcaccgattttgtgacttacacctgtatagaaaaggatacgctcagaggtagttgttttacctgcgtcgatgtgagcactgataccgatattacgatagcgctcaatgggagttgtacgagccattattattacctttttgggaatctaatgtgaatttgtttatatagtaataggcttcatcgcaaattttgagatgaagcctacaaacatcaaaagcttattaccaacgatagtgagcaaacgctttgttagcttcagccatacggtgaacatcttcacgttttttcactgctgaacctttgttgtctgctgcatctgaaagttcgttagctaaacgcattgccattgatttgtcaccacgtttacgtgctgcttcaacgatccaacgcattgctaaagcattacgacgagttggacgaacttctactggtacttggtaagtagaaccaccaacacgacgagatttaacctcaacagttggacgcacattttcaagtgcgatttcgaatgcttctaacgcttctttaccagagcgttgagctaatgtttctaacgcaccgtaaacgattgactctgcgatagattttttaccatcaaccattaaaacgttgatgaattttgcaagtaattctgaaccgaacttcggatctggaagaattttgcgtggttcaatactacgacgacgtggcattgcaatttctccgtattataaatcttcaggatatccaaaactcatcttttgcgacaaagcgcctttgactggagtttatggtttaaatattaatttagacgtttggccttacttaacggagatccattaagacttaggacgtttaacgccgtatttagaacgaccttgtttacggtctttaacgcctgcacagtcaagtgcaccacgtacagtgtgataacgtacacctggtaagtctttaacacgaccaccacggattaatacaacactgtgttcttgaaggttatgaccttcaccaccgatataagaagttacttcaaaaccgtttgttaagcggatacgacatactttacgtaacgctgagttcggttttttaggagttgtagtgtatacacgagtacacacaccacgtttctgcgggcaagcctctaatgcaggaacgttgctttttacaacctttttcacacgcggtttgcgtactagctggttgatagttgccattaataaagctccagttaaaataaaaaacaataaaaaagcctttcacagacgaaaggacggtgaattctagagctaatgaagcagagtgtcaagtgctttaacttttcgccttttgatctgataaatagcgccaataatattatttccttataataggcatattcatctttattaaaggcatactctatgactcaaatgaaaattggtgtgttactcgcaaacttaggcacccctgacgaacctacaacacctgcagttaaacgctatctcaaacaatttttaagtgatccacgtgttatcgatctacccaagtggaaatggcaatttattctcaattttatggtgttgcctaaacgtgcaccaagagttgccgaagcctataaaagcatctggacagcagaaggttcgcctttgctttccatttctcgccagcaacaaaaagcggttcaatcctatttcaatgccaaaaatccaaatgtcatcgtagaattaggcatgagctatggcaacccaagcattgacagtgcagtagaacgcttgattaaacatggcgtggagaaaatcattgtacttccgctttacccacaatatagctcaacgacaacagcttccgtgtttgatgcctttgctcgtgcacttacacaacataagaaagtcgttccttttgaatttatccataactatcataatgagcctttatatatcaaagctctcgccaataccgttcaattagaaaaagatgagttactcctcttctcttttcatggcatacctgctcgttatgaaactgaaggcgatttctatgcagagtattgccgtaaaacggcacatttagttgcagagcaactcgatctcacggaaaaacagtggcacatttctttccaatctcgctttggtaaagaagaatggctcaaaccttatactgatgaaaccttaatgggctttccagccaaaaacatcaaaaaagtggcagttatctgcccaggcttctccgcagactgtttagaaaccatagaagagattgcagaagagaatcgtgaaaactttgagcacgcgggtggagaaagttaccgctatattcctgcgttaaatgccaatagcgatcatatccgcttactcgttaaacttatcgaagacaaattagcttaattttataaagcctttttctctctatctttggggagaaaaaggctttttccttcacataattcactccacaatttaaatttttaaatgaaattcaataaaactggaattttatttaataaaatttaattaaatcatattttgtttatatttttatttctaactattgttgatttaatagaaattggttaacttctttttgcacccaaaatggagtgtattaatcaaaatatacaggagttaaaccatgaaacaaattacaacaattataaatccttttcgtcttgatgatttaagagaggcggtttctgatcttggcatacatggtatgacagtcacagaagtcaaaggctttggtcgtcaaaaagggcatgtcgaaaactatcgtggtgctgaatacgcagtggatttcctacctaaaatcaaggtggaaattgctgtcagtgatgatgttgtcgaggatgtcattagcgcaattcagcaatccgttaaaacaggcaaagtaggtgatggaaagatttttgtcaccgagattgaacgtgttatccgtattcgaacgggtgaaacagacgacgatgctctataagacaataaggatatgattatgaaaaaattatcaattttacttggactttctcttttacccactttgagccatgccgaaacatcttggtggcaaccattatcagccctaaatagtggtgatactgcatgggtcatgatttctgcgattcttgttctctttatgacgattccaggactcgccttattctacggcggtatggtgcgtaagaaaaacgtacttagcacaatgatgcacagtttttctgtaaccgctttaatttcagtattatggattacagtcggctactccttagctttcaccgaaggtaatgcgtttatcggtggttttgatcgtctattcttatctggtatgggattagatcttgctaaagaaatgacgaccattgcccctaacgctagtacgatacctgaagccgtatttatgtttttccaaatgacctttgctgtgatctctgtggcgattatttcaggtgcctttgcagaacgtatgaaatattccgcaatgatgtggttctctggactttggttcttactggtttatgtaccgacttgtcactgggtttggggcggtggctttatggctgaaggcggtgttttagactacgctggtggtacagttgtacacattaacgcaggggttgcagctttagtggctgcgattgtagtcggcaaacgtgtcggctatggtaaagaagcaatgccaccacacaacatggtttacactttaatgggtacagcaatgctttgggttggctggtttggcttcaacgcaggttctgccgtggcggcaaacgcctctgcgggtatggcgatggcagtaacacaaattgcagcaactttcggtgcattaacttggttaatttgtgaaaaaatcgcaggacatcgcccttcggcattaggtttagcttcaggagcagtggcaggattggttggtatcacaccagcagcaggttttgttgatccgcaaggtgccatctttattggaattatcactgctgcagtttgttacttcgctgtttcagtactcaaacacaaattaggttacgatgactctttcaacaacacgatttttggtggcgaagcgactgtaggtagccaagtgttaacacaattaaaagatgtggtcattaccgtgctttatagtggtatcgtaagtttcattctcctcaaaatcattgagaaaatcacaaaaggcttacgagtggaatgtgatgaagaacgtgaaggtttggatattaccatccatggcgagcgtgttgaataacgattaacaagacaatcgaacttacaagcggtaagatggactaagttttttgcaaatcattagtcaaatcttaccgcttatttttaggagataaaatgaaaaaaacgctctcttttagccttattgcccttgctttaggcttaacggcttgtacctcgaaaacctaccaaagcaccttaaccgaaggggtggataacagtgtttctccacagcaagacttttatcgttatgtgaatggtaagtgggtagataccacccaaatcccgtctgatcgcacttcttggggaaccttagcagaactcaatgaattgaatgaaaaacgttctgttgagctgttacaagcggtgatttcaaacccaaattttgcgaatgatgaaaaggcacaacgtttaaaagcactttatcaaagttataccgatttgactgcccgtgaaaagcttggtttaagtccaattcaagctgatttaagccgaattgagaggataaaaacctttgccgagttagagcaatatttaattaatgaaaccaagcaaggcaatgagatgctatttggttggtcggtatttgcccacctgaaaaactctcgccaaaacgcaatctatttcagtaatgatagtcttggtttgagcaatgattattatcaaaaggatacccctgaaaatcgtaaaacattacagctttatcaagattatgttgcacagatgcttcattttgctcaggtaaaaaatccgaagcaaaaagcaaaagcgattgtggagtatgaaaaagcgattgcgaaaaccctatttaccaatgagcagcgtcgagatattcaaaaacgctataatcctttatctatcaatgaattagctaaagcgagtaaacatattaatcttgcaaattatctcaacgccgttggggtgaatacggaagaagtcattgtgtgggagccgaatttcttaaaacagtttgatcagttcatcaacccacaaaatcttgcgttaattaaagattacctacgctttaaaaccatttcaaatgcgtctacctatttaaacaaagccttagatgatgcgaattttgctttttatggcaagcagttggtgggacagaaacagcaaagaccgttagataaacgtgcgttacgtttgattaacaaccaaattgggcaggaatttgctcaattttatgtggaaaaattcttccctgcgacagctaaaaaagacctgcttgaaatggctggttatttggttaaagcctaccatcagcgtatcgacaatttaagttggatgtcggcagaaaccaaagcaaaggcgaaagtgaagctagataaattcatcgttgaagttggttatccaaacaaatggaaagattatagccaactgcatttaaaaaccgtagaacagggcggttcgctttatgctaacttgcgtgaaattgccaaatggaattaccaagaagccttaagtaaaatcggcaaacctgttgatttgaatgaatggggaatgttgccacaggtagtgaatgcctcttatagcccattgatgaaccgtattgtattccctgctgggatcttacaagcaccactttacgatatgaacgccgatcctgccgttaattttggagctatcggagctattatcggacacgaaatcactcacggttttgatgatagcggttcaaaatttgatggtgatggcaacttaaaagagtggtggacagccgaagatcgacaaaaatttgaagcccttgccgatcaactagttgctcaatttgataaatttgaagttgccccaaaaatctttgtcaatggacgtttcaccttaggggaaaacattgcggatctgggcggattaagtattgcgtatgatgcattaaaacgttatgagcgagatcacggtgtgaccccaatcttggaaaactttaccccagatcaacgcttttttatgagctggacacgttcgtggcgaaataaagcgaccgtccaagccttaacccaccaagtgaaaagcgatccacacgccccaggacaataccgtgcttttgcccctgtattaaatatctctggcttccacaatgcctttaatacaaagcaaggtgatgcaatgtatcgtccgattaatgagcggattaagatttggtaattaatgataaataaaaaaacgccagttattaaaactggcgtttaaaataagtggcggaggaagtgagattcgaactcacggagggtgttaaccctcgccggttttcaagaccggtgcattcaaccgctctgccattcctccgagttgaaagctatttttaatttttatttgctctttagagcgaaaacctgctgataattgcttatcaacaggctgtatattcagtggcggaggaagtgagattcgaactcacggagggcgttaaccctcgccggttttcaagaccggtgcattcaaccgctctgccattcctccgctgaaaacaggtaaaatagtatagataactctgaactaggtcaagcacaaaatgatgcaaaaccgtcaaatgttctatttttcgcctacttagctgttacgaattaaccaaaccccactttcaatatgctcggtgtaagggaattgatcgaacaatgcacagcgttcaatgcggtgagtttgagttaattgttttaaattgtcggctaacgtatgtggattgcaagagatatagaggattctttcatagccctgcaccatttctaatgtggcttgatcaagccctactcgtggcggatcaacaaaaatggtattgcaatcatattgtttcaaatcaataccacgtaagcggtaaaagacccgaacgccattcatcgcttccgtaaattcttccgcagacattcggataatttgcaagttatctacgccgtttactgcaatattatattgggcagattctaccgatgattttgaaatttcagtcgctaataccttacgaaattgatttgctaacgcaattgaaaaattaccattgccacaatagagttctaataaatcacccttactatttgccgtacaagctctcgcccattccaacattttgatgttcattttgccattgggctgcgtaaagctgttttctacttggcgatagcggtaaatttgcccatcaacattcaaggcttcttctacataatcacaatctaatgcaattttttgcttcgtcgcacgcccgattaactggacatcaaaaccatagccgatcaagcgttgtttaagtaacttcgcttgctctatccattcttctgtcagcgatttatgataaagcattgaaacggcgatttgcccacttaatgtacttaaatagtcaatctgaaacagcttacgtgtaagtagctcattgcctttaatttcagccagcaacaccgtcatcattcgattaatcagttgacttgcaatcggaaattgatcgacacggtagcgttgcttagtcgcctgatcgaacataatgtgatagagatcaccattatcatgccaaacacgaaattctgcacgcaagcgaaaatggcttgtgtcagaggcaaaaacgtcaagttcaggtgcattaaaaggtgcaagtagagcggtgagattctctgccttttttgcaagtaacgctggatattgatgaattggtaaggtcatttgaatttatcaagaaagaaaaagaaaaggctttttcaagccttcccacacattattctgctgaatcgtcgccaccaaggtcgccacttacatcgcctgaaagggtgtagatgcgtttggttttactggttaaatcacggtatttaagccacgttttttctaagaaagtttctgtaactttttcacctttaacaaccgctacgaactgtttttcttccgctgtagcaggttcacgttcaccgttttctaatgctaagcaggcttgaccaaattgctctaaggtttgcgattcacgaatggtgtaatcaccgtgacgagagaaaccacgaggataatttttatcgtcgaaaaaacgacgtgttacgctaaaactttctgccataattgcctctatttacacttttatttagaaaaatcaaaattgggcaagcattaaagctaaaacttgggaaaagatcaatggtttattgatataaaaacaagaaaagagatagactaacccgaatcccttataaaaactgaggcagtctgagatattcacactgcctcatcaacattttatttataatcttgagccaatttacccgcagcttctaccaccacggaaaccgcacgatcttccgtgcctttaatggttgcttcgtttgggatctcttgttgagtacggtttacgattacacctgcaaccattcctgaacgtaagcctaatgcagaacacatagtgaagagtgtcgcagactccatttcaaagttcatcacatttaattcttgccactgtttcaatgaaccttggaaatggcggtagattttgcctgtgaatgtatcgtaacgctcttgacctgggtagaaggtatcagatgatgcggtaataccaacataaggatcgataccttgatttttcgcagctgcataaagctcattcgtacaacggaaatcagccaccgcaggatattctaatggtgcaaaatggcgacttgccccgtctaaacgtactgcacctgtcgttaccaacacatcacctacattaatatgcggttggattgcccctgttgtaccaatacgcaagaaagtacgcacgcctaattgagcaagctcttcaacacagatagaaaccgatggtccgccaatacctgttgagcaaaccacaattggctgaccgcctacataacctaaccacgatgtaaattcacgagttgaagctaaaaactctggattatccatttttgctgcaatacgctcactacgagctggatcgccaggaacgatagcaacttttgccccttttaacattgctttggttaagccaagatgaaatacctctgacataattgactccttttgagaaaaattcgagtaatctaaccgcttcattctaccaatcaagcgatcagaattgcgatcttttttgcaaaccaatgttcaaaaatgtgaacaagatcaactggaaacgtttgcttgaggtttaatttctctcaaaattgggttttgcattgaaattagggtgtctgttgattgaatttcatcaatgccctgaattttagtagctaaaacatagtgcaattcttgaatggtatgggtcatcactttaataaaaatagagtaatcccccgtggtgtaataggcttcaaccacttcatcaaactcctgcaactttgcaatcaccttttcataatccttcgcactttttagaataatcccaataaaacagcagacatcatagcccagtttacgcggattaatgcgtactttagtgccttcaataattcctgcttgacgcattttttcaacacgaacgtgaattgtccctgcactcaccccaaaattttttgccatttcagcatagggaactcgagcatcttgggttaaaacttgcagaatttgttgatccagtaagtcaatctgcgatgttgcctgatagtttttatgcattttctgttccttttctatcttttgttagaaattaactaaaatatagcataaattattagatgatatctaatatagattgactttgtttgatttttttatgtaagttgttgcgtttatcaagaattaatttaaattacgcacatctcttacagaatttattcaaaaggaaatttattatgcaaaaatcatttattcttcaacaacaagaaatcagctttgttaaaaacacctttacccaaaacctcatcgaacagttagatattattgaagtacaaggtccaattttaagtgaagtaggcaacggtatgcaggataacttatcaggtatcgaaaaagcggtacaagtgaacgtaaaatgtatcccaggtgccgtttatgaagtagttcactcactcgctaaatggaaacgccacacccttgcacgttttggtttccaagaaggcgaaggcttattcgtccatatgaaagcattacgcccagatgaagactcactcgatccaacacattctgtttatgtggatcaatgggactgggaaaaagtgattccagcaggaaaacgcaatttcgactacctaaaacagactgttcgctcaatctaccgtgcaattcgtttaactgaattagctgttgaagcacgttttgatattccatctgtattaccaaaagagattacctttgttcacagcgaagatttagtgaaacgctacccaacattaaccagcaaagagcgtgaaaatgcgatttgtaaagaatacggagcggtattcttaatcggtatcggtggcaaattatcagacggcaaagcgcacgacggacgagctccagactacgacgactggacaacggtatcggaaggcgaatataaaggcttaaacggcgacatcttagtttggaacgaacaacttggtacggcatttgaattatcatcaatgggtatccgtgttgatgaaaccgcactacgcttacaagtggcattaacaggcgacgaagaccgtttagaaatggactggcacaaagatttattagcaggacgtttaccactttcaatcggcggtggtatcggtcaatctcgtatggcaatgttcttattgcgtaaaaaacatatcggtgaagtgcaatcaagcgtatggccgaaagagatgttggcgaagtttgagaatattctttaatattatctcaaaagcaggctaatatttttccagcatagtagacaaagtggttgctaatgaatattttaattattcttagcaactctttttatttaaaaaaatcctttataaacataatcttatgtcttttcattaatcctgtatgatgcgataattttcctttagttgcccaaataagttttcaagtctatttgtcgttttttcgatatttaaatcgccatgcttttcataggtaaatagataatccatataacgtttaaaaccatgataagcacttcttacatttctatgtttataaggataatagcccttttcattcggtttatctgaccgttcttctaaaaaacgctttatgttttaaataccaatgatgtaatcgtaaatagaaatcttttttagcgctctgtttaagtgtcaatgcaataatttttaattcttttccagctatagattgatgtttttttcttaatgctctcatcacaatagctaccatatgaaaatggcacatttgcgtcggtgtatctaatatttaaatcacgtgatagtggtggatttaatttctttttaagggtaaatgttttattacaagcattacatttatagcgttgaatattatttcttataccatgtttgcgaatgtcgctactgtggcaaaaatgacattttttgggttcataattcaaaaaagtggcttaaagcgcgtaatgtaaggctttaagccactttttagcaaccattttgtctactatgccttctatctttgttttgtccactatgcctaaatttgttcttctgatgacattatttgcgaagttacaacagctttaggatctgctccatatttattttcaaaacgatctccatcaacgaagaagagcagtagatggaaaatgacagtgataattaatactacaataagggcaactgctttcagcgttgaaaaatgattgttcataacatcttcaatattatacgctgcaatgactataacaattgacgttgctatctgacaaagctgccaccagccagaataacctagatcgtgcaaacggcgagtaacaaggttgattgatggaataatcaaaattaacccaaacaataaatttaatccattgagtagttccgccaaactaaacattcgtaatacagttgcagctgaactaaataatgaaaaacagagatcaatcagaatgatgattaagataaaccagccatactctgctcgccttgctctgcctttaaagttaaagctgttttttagtgcgtgaataaaccattccattgtttctctccttatcgttaggttaaattttgtgaaaaatgaggtttatcttaccgcttgtaaacttcaatatgcggattattcctaataatttgctatgaagacggtgttagatagcctatcgcataatctaacgcataatcataaccttttgctcctaagccacagatcacaccttttgccacatcacttaaataatagtgatgacggaaaggttcacgagcatgtacgttggatagatgaacctcaataaaaggaatagcgacagataataaggcatcacgcaaggcgacgctggtgtgagtaaatgcacctgggttgataataataaaatcaaccttttgaaagccttgatgaatgcgattaatcaatggttcttcaccatttgcttgaaaatagtcaaacgcaaagccttgtgcttctgcttgttgttttaaatgttgttcaatgtcagaaagggtttgtgagccgtagatatgcggttcacgttttccaagcatatttaggtttgggccgtttaatagtaagatggttttcatacattctcctataggatatttgtatttaatttatgtaccaacaatatcattacatattaaagcatatttttagaaaaaaatactaatctaattaaagttgtttctgatttaaagttcttatttattccgataatatctttcaaatcagtaggtagcaaagggttattaaaaggaagggctattgtagactttagataacctattttatttttaagaattgggcggttgggataaatgatggatgcaaaaaaggcaatatatttgactatattgccattaaaaataataatgatgctatgcccaatatttatcaatttccgcacgaattgcttcagcggttgctttacctttttcaccgactaaggctcgacctgcaataaaggctttggcatttttaacttctttgaaaagatgaatttcttcaggaacgataccgcctgtaatggatagttctaaaccttttgcagaaagttgtttcataagttcaatatcttctgctgtccagccttttcctgctaattcagcatcgcgtgagcggtggtaaatcgcttgtttcacgcctaaatctacccactcttgtgcgtctttttcaacggtccagttgccgtagatttcgatttgaatttcttttttcacttttaatgcagggtgagcggcattaaattcatctgccacttttttacaagctgctttggttgctgggtgagctgctgctgaaacggtaagccagtccgcgcctgcttcaaatgccattttggcaaggattgcaccgccatcggtggtttttaggtcacatacgatgatgtggtttgggtgtaatgctctgagtgttgaaatggctttcataccttctgcacaagctaggattgtgccacattcgataatatcgacaacatcttctgcttgtttggcatcagcgacggctttttctaaacttaaagagtcaagggcaatttggagaagtggttttgacatattattttccttttaaagattaaaaattagagttacaagcggttagatttgagaaattttttatattattctgtagggacacactgtgtgtgtccgctcatcgtttgtattttgtgtggacacaggcagtgtgtccctacatttttatataacagctggtgcgatggagaatatttactaaaaacaatgttttcccaaccgtttgtatgaattaaccgtttaatgcggcatcaattactgcatagacatcttctgcagttttgcagcggcggattttatctaaatcaacgcctgtgtcgctatctggatcatcaagcacttgggtgatttccattaagccttgcatatgttgatctgagtcgctacctgcaagggttagaagtacatcaacaggctcatcttcaccatcaaaatagattggtgtttcaagggtaacaagtgcaaatgatgttttgattaccccttcttctgggcgtgcgtgtggcatcgctaaacctggtgcgagaatgatgtaaggtcccatctctttgattttgcttacaatattgtcgtaatagcgtggttcaatcgtgccagccgcaacaagtaaatctgtgccgattttgatggcttcttcccagttgcttgctgattgatgaagcttgattgagttattttcaattaaagattgttttaaattcattgtacacctcttggataaattcccccctaagaaggggaggattgactaggttacttagcgttatgtttattgattaactcaacgagttcatcaccgaatgagttagggtttaacatatttttcacgcctaagaatgctttgccttctggcacttcaatttctgctgctaagtgttgagatgaaacgataatgtcgatttcatttaattttcctttgtagtccgttacggcacaagagtccataatatttgggataccacgtttatctaagtagcctttgatcttcattttcatcatcattgatgagccttgacctgagccacataccgctaagatacgaactggttttgcaccactttgagcaggtgatacttctgctttttcttctacttttgtttcttgttgggtttgaacttcatctaagccgtaaccgtctaattgttcaagggttaagccttttgctgcagcttctgcttcttcagcgcgtaagttgcgagaagcaaagaacatataaaccatagctagagcaacaatgatgaagaagaagcctggtacgctaatgataccttgtaggattggtgggaagaataatgcccagtcagccatacccatccaaccgttgaaggttgtaccttggcttgctaacatttggattacccacgcagaacctaatacttcgatcatacccatcacgaaacagattttcattactgctttccagccaccgaattggtttgcaaatacaccgattgttgcgttagagaagaacatcgggataaagcctggaatgatgagaattggtgagccaaagcctaataggatacctaccgctacgaattgaccgattgcaccccacataaagccgaataccattgcatttggtgagaaagcatagattgctgcacagtcgattgcaagtactgagttcgggattaaacgttcagagatacctttgaatgcttctgaaagttctgcaacgaacatacgcacaccggttacgatgatttgaattgctaccgcaaatttcaagcccatttcaagaatgtacataaaccagtgggttttgcctgccatttgttgcaagttatctaaaccgaatgaaagtaagatgatgccgaagaagatcgtcattaccaacgctgttgcagagatgctgtcgtggaagatatgtaaccattttggtaggtttatatgatcaacagagtcatctttgttaccgagtttcggcgcaagttttactgcaatccaagacgcgatttgttgttggtgaccgatagagaaacctgcaccgccagtaaccgcttgcgttggtttatacataatgttagaagagataccccagtagagtgccattaacacagaagtatagataatggtttcccacatagaagcaccgatgatcatatagaacaccgcaacaagcccagcttgttggaacataatatgccctgtgagcataatggtacgaataccggtaaagcgtctaaacacaacgagtaaaacgtttaaaattaacgccccaataacggcataacctacccatgcatagttgtctgccattgtttgaatagtcgcttgcatactggtgtaagggtcgattactgcacctgttaagttatggaatttagataaaccttcgataacaggtttgaagttggttacaaggaaacccgaacccgcttgtacaatcataaaaccaacgatggttttgattgtccctttaatcacggtggtggtgtcttttttgagaagaatgtaacccaagcaagctacgataccaagtaagaatggtgctttatttaacacctgatcttttaaaaagagcaggatatctgtgagcatttccataagagtacctcttatttatcaatatgtatggagaaaaattgatctcagcttaacgctgagcgtcagaaattctgataagcacgaatttaacatcatacataatagcaatttcctaagattaaaaaagattgaatttgattatttgtgaactatgtcacattattttttgtaagggtgattttttactcttacaaatggaaaggttgataaaatgttcttattttaatgaaaatgttgcatttattataaaatacaatatttttcaataagttgtagatgagatccattatcaacaattagtatttacagaaaaaaattagatatagatcacaaaattacaaaaaaagagtgtacattttattgtgattggatatgattacttatgattattctattctttcctaactttgttaatcataggagctaacaatgagcaaaatttcagaaatcacccgtgaaagttggattctttctaccttccctgaatggggtacttggctaaatgaagagatcgaaaatgaagtcgttccagaaggcaactttgcaatgtggtggctcggctgcgtgggcgtatggattaaaaccccagcaggtgcaaacatttgtatggacttatggtgtggtcgcggtaaaagcaccaagaaagtaaaagatatggtgcgtggtcaccaaatggcaaatatgtcaggtgttcgtaaattacagccgaacttacgcgctcaacctatggtactagatccatttgcaatcaatgaagtggatttcattcttgcttctcactaccacagtgaccatattgatgtgaacgtagctgcagcgattgtaaacaatccgaaattagatcacgttaaatttgttggtccgtggcactgtgcagagctttggaaaaaatggggtgtgccagaagagcgtattatcattgtgaaaccaggcgatgtggtgaaattaaaagacgttgaaattcacgcattagactctttcgaccgtacctgtttagtcaccttaccagtagaaggtgcagaagctcaaggtggagaattagctggtctttgcccatcagatgaagaaatgggtcgtaaagcggtgaactatgtgtttaaaacaccaggcggtaacatttatcacggtgcagactctcactactctattcaatttgcgaaacatggtaaagagttcgatatcgatgttgcattaaacaactacggtgagaacccagtaggtatcgcagataaaatgacctcaatcgatcttcttcgtatggcagagtgcttacgttgtaaagtgattattccagttcaccacgacatctggacaaactttatggcaagcacccaagagatcattgacttatggcgtatgcgtaaagaccgcttacaatacaaattccacccattcatttgggaagtgggcggcaaatatgtttacccacaagataaagacttaattgaatatcaccaccctcgtggttttgatgactgcttcgagcaagaaccaaatattcaattcaaatcaatgctttaatcttaatcaatcccccccagtaaaatgggggaaattgttcattatttggtttaaaataatcataaaataaggagatgaataatgaacgaaaattatagacatcggcaattactcgatcttttaacggaaagaaaagcactttcaactcaagagattattgaattactaggtatttcccctgcaacagcacgccgagatattaataagttaagtgagcaagggcgtttgtataaagtccgtaatggtgcagaagccatcagtgtgggctttattccatcgaatagagaaattaaaaataatgatgaaaagcaacgcattgccgaagctgctggcaaattgtgcaaagaaggggatagcgttgtattaacttgcggttctacaatgtcgatgctaggtagcaggttatgtggtcaacgtttgcaaattattactaactatttaccgcttgcaaatcatttgattgatcataaccacgatgatgtggttattcttggcggacaatataataaaaataaagcgattacattgtctatcagtggaaatgagatgagctatgcggcaaatattatgtttacgagtgggaaaggttttacgctagaaggtttatataaaactgatatgattatcgcccactctgaaaatcagatatcgtcaaaagctcagaaatatgttgtgctactagatagtataaagctaggtaaacgagtaggaatgttatttagtgaactgagcaaaattgatattttgattacaggttctgaagctgatcctgaaatcattaaacaacttagagaaaaagggttggaagtgattttggcttagaaatcctgatgttattgtaggggcggaccgatgtgtccgccctaacaaatcagaaggcaagcggctacaaccttcacatattttacatttaaccaaaggggttaagaatgagaaaacataaactaggtatttatgaaaaagccttacccaaaaatatcagttggcaagacagactgtctatcgccaaaacctgtggttttgactttgtggaaatttccattgatgaaactgatgaacgccttgctcgccttgattggggtaaaaaagagcgtttaaaacttgtgaaagcgatagtgaacacaggtgtaaccattccatcaatgtgcctatcagggcatcgccgtttcccatttggtagtcgtgatgaagcgactcgccaaaaagcctacgaaattatggaaaaggcaattcaattagcggtggatctcggtattcgcaccattcaacttgccggctacgatgtttattatgaagaacaagacgaaggtacaatccaacgtttccaagaaggcttagaatgggcggttgagttagcggcaagtaaccaagtgaccattgcggttgaaattatggatactaaatttatgagttcgatttcccgttggaaaaaatgggacgagatcatcaaatcaccgtggtttaccgtttaccctgatttaggtaatctttctgcttggaacgacaatgttgcggaagagcttaaacttggtatcgacaaaatctcggctattcacttaaaagatacctacaaagttactgaaacctgtaaaggtcaattccgtgatgtaccgtttggtgatggttgcgtggattttgtcagttgcttcaaaacccttgcagaattgaactatcgtggggcatttttaattgaaatgtggacagaaaaagcggaagagccgattgctgagatcatcaatgctcgccgttggattgaacaaaaaatgaaagaagggggcttcgaatgttaaaagaattgcgtgaacgtgttttaaaagcaaatttagaattaccaaaatataaattagtcacattcacctggggtaacgtgagtgaaatcgaccgcgagtctggtttagttgccgttaaaccatctggcgtagattacgatgtaatgacagctgatgacattgtgattgttgatttacaaggcaatcgtgtctggggaacgaaaaaaccgtcttcagataccccaacacacttagagctttatcgtcaattccctgaaattggcggcgtggttcatacacactctcgccacgcaaccgcttgggcgcaagcaggggaagatattttggcacttggtacaacacaaggcgattacttctacggctctgtaccttgcacccgccgtatgaccccagaagaaatcgcaggcgaatacgagttggaaacaggtaaagtgattgttgaaactttccgtaaacgtgcgattgagccatcaatggtacctggcgtgctagttcactctcacggacctttcacttggggtaaagatgcatttgatgcagtacataactcagtagtattagaagaagtggcatatatgaattttgtcagccaccaaatccgtccgaatatcggttcaatgcaacaagaactgttagataagcattacttacgcaaacacggtaagaatgcgtattatgggcagtaataaatcggtgtaatagaaaatttgttgctaaaaagtggcttaaagccttatattacaagggtttaagccctctttttgaaatatgaacaaaaaaactgcccattttgccaaagtctgaaaataaagaaacatggtacatcaaataatattcaacgatatttttgtcataaatgccataaaaccttttccttcaaaaataaattagacccaattaaaatttggactgattacacatctggaaaacaaacctatcaacaacttgccgttaaatatcattgttcagtcagaacgattcaaagatatattgataaagcccctaaaacatctttaaaaccgcctttaaatcgacatctgaatatcattatggatacaacattcttcggtcgttattttggcgtattagtgttaatggattcaaattcaaataacgtcattgcccattattttgtccgaaccgaaaaagatatttactacaaacttgctctgaataggttaagggaaaaggctatataattcaatcgattacctgtgatggtaggcgtggtttgatgaaagatttatttaatacaccagtacaaatgtgtcaatttcatatggtagcgattgtgattcgaaaattaagaaaaaagcaccaatcacaagcgggtaaagaattaaaaataatcgccaaaacactcacacaaagctcgaaaaatgaattttatcggagattacattcttggtttataaaataccaagcgtttttaaaagaacgaagtgataaagcgaatgaaaaaggctattttccttataaacatcgtaatgtaagaagtgcttatgccagtttaaagcgttatatggattatatttttgtctatgaaaagcatccttaattaaatatagaaaggacgacaaattgtttagaaggattatttagtgaacttaagcgaaaattaaataatcacaatggattaatgaaaagacgtaaggtgttgtttatacaagattttttaaataaaaagagttgctcagaataattaaaaagaccctatcccaaattctgtgtaaacacccatttcaacttaacggtgatcgtctaggtgatcaccacaatcaatcataaatcgattcattgccagtttccagttctgaatcggcattgtccatttttttgatgcatctttagtcgcaagccaaatcactttgaaaactgaatcatccgtcgggaatacatttcgttttttaatcacgctattaagcgattccacggcattcgtggtataaatcgctttacgaatatcagccggataatcaaaaaatgtggcaatatttgcccggttatcttcccggcctttcgccacaagcgggtattttgcctgccatttttgcgaaagtgcggtcagattttcgcgagcttgtgcttccgtcggggcctgataaacctgctttaaatctgcagtgacggctttgtaatctttccacgaaacgaatttcaagctgttacgcactaaatgcacaatgcaaagcttaaactacgatacaatctaggtaaacaattggataaaccgcatcaagtgggcgattttgccatgccattacgcgctctttcacggcgtcggtaacgcgagaaatcaggctggttgatacatccgcatcatagagttctttgaacatttcaacgatttcctgattacttaaccccttggcatataaggcaataatctgctcatccattcctgtgatgcgggtttggtttttcttgataagttgcggttcaaaggtgccgtcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgattttcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctcgtgtctgtcagattaggtttgatcttctacacattagcaaccattttgtctactatgtcattttatacatactaaggattacgcttaaacttgctaaagtcaggcgcacgtttttcattaaacgcattacgaccttcttgaccttcttccgtcatatagaacaacatcgttgcattacctgctaattcttggagacctgcttgtccgtcacagtctgcatttaacgccgcttttaagcaacgtaatgcaatcgggctgttgcgtaacatttcacggcaccaacgcaccgtttctttttccaaatctgcataaggcacaacggtattcactaagcccatctctaaagcttctttcgcatcatattgacggcataagaaccaaatctcacgtgcttttttctgcccaacgatacgtgccatatagcttgcaccccaaccgccatcgaatgaacctactttcgggcctgtttgaccgaagatcgcattttctgccgcaatggttaaatcacaaagcatatgtaaaacgtgaccgccaccaatggcataaccagcgaccattgccaccacaggcttcgggcagctacgaatatcacgttggaaatccaatacgtttaagtgatgtacaccactttcgtctttataaccgccgtaatcgccacgcactttttggtcgccaccggaacagaacgctttttcgccttgacccgttaaaacaatcacaccgattttttcatcaaaacgcgcatcagagaaagcttggatcatctcttttaccgtttgcggacggaaagcattacgcacttcagggcggttaatggtgattttagcgataccgtcagtcgatttatgatacagaatatccgtataaccttcgctgcaatcgagccactcaacaggggcataaagtacatcatcttttgggttttgcattttgtattccttttagtttaaataagtggataaattatactaggaatttatgaatttttccttgattatatactcagcctctcttctatgggaaatttgtatattaccaaatcttaatccgctcattaatcggacgatacattgcatcaccttgttttgtattaaaggcattgtggaagccagagatatttaatacaggggcaaaagcacggtattgtcctggggcgtgcggatcgcttttcacttggtgcgttaaggcttggacggtcgctttatttcgccacgaacgtgtccagctcataaaaaagcgttgatctggggtaaagttttccaagattggggtcacaccgtgatctcgctcataacgttttaatgcatcatacgcaatacttaatccgcccagatccgcaatgttttcccctaaggtgaaacgtccattgacaaagatttttggggcaacttcaaatttatcaaattgagcaactagttgatcggcaagggcttcaaatttttgtcgatcttcggctgtccaccactcttttaagttgccatcaccatcaaattttgaaccgctatcatcaaaaccgtgagtgatttcgtgtccgataatagctccgatagctccaaaattaacggcaggatcggcgttcatatcgtaaagtggtgcttgtaagatcccagcagggaatacaatacggttcatcaatgggctataagaggcattcactacctgtggcaacattccccattcattcaaatcaacaggtttgccgattttacttaaggcttcttggtaattccatttggcaatttcacgcaagttagcataaagcgaaccgccctgttctacggtttttaaatgcagttggctataatctttccatttgtttggataaccaacttcaacgatgaatttatctagcttcactttcgcctttgctttggtttctgccgacatccaacttaaattgtcgatacgctgatggtaggctttaaccaaataaccagccatttcaagcaggtcttttttagctgtcgcagggaagaatttttccacataaaattgagcaaattcctgcccaatttggttgttaatcaaacgtaacgcacgtttatctaacggtctttgctgtttctgtcccaccaactgcttgccataaaaagcaaaattcgcatcatctaaggctttgtttaaataggtagacgcatttgaaatggttttaaagcgtaggtaatctttaattaacgcaagattttgtgggttgatgagctgatcaaactgttttaagaaattcggctcccacacaatgacttcttccgtattcaccccaacggcgttgagataatttgcaagattaatatgtttactcgctttagctaattcattgatagataaaggattatagcgtttttgaatatctcgacgttgctcattggtaaatagggttttcgcaatcgctttttcatactccacaatcgcttttgctttttgcttcggattttttacctgagcaaaatgaagcatctgtgcaacataatcttgataaagctgtaatgttttacgattttcaggggtatccttttgataataatcattgctcaaaccaagactatcattactgaaatagattgcgttttggcgagagtttttcaggtgggcaaataccgaccaaccaaatagcatctcattgccttgcttggtttcattaattaaatattgctctaactcggcaaaggtttttatcctctcaattcggcttaaatcagcttgaattgggcttaaaccaagcttttcacgggcagtcaaatcggtataactttgataaagtgcttttaaacgttgtgccttttcatcattcgcaaaatttgggtttgaaatcaccgcttgcaacagctcaacagaacgcttttcattcaattcattgagttctgttaaggttccccaagaagtacgatcagacgggatttgggtggtatctacccacttaccattcacataacgataaaagtcttgctgtggagaaacactgttatccaccccttcggttaaggtgctttggtaggttttcgtggtacaagccgttaagcctaaagcaagggcaataaggctaaaagagagcgtttttttcattttatctcctaaaaataagcggtaagatttggctctagaccttcttaccgcttatcagttcaattgctttagttattctgtacatacttccgctaagtagtaataagattaaggttatcttttataaattatgcggatttcgagtatttgcatcaaccaaattacgcattaacaaagcataatctaattccacatcggctggtacatctaaaaagacaaaatgcccatcgcctaaaccagcttcaatagcttcatttttgcggtttaacattcgttcgattttgaacacgatattgcctttcggggtcatcatttcaacttcatcgccaagtaagaatttatttttcactgcgacttccgccataccttctgtattgcgtttgccggtaaattcgccgacaaactgctgacgttctgaaatcgaatagccgtaatcgtaattttggtattcatcgtgggtatggcgacgtaagaaaccttccgtataaccacggtgtgccaaggattctaacgtatccattaaactttcatcaaaaggcttgcctgctgccgcatcatcaatcgctttacggtaaacttgagcagttcttgcacaatagtagaatgacttagttcgaccttcaatttttaaggaatgtacgccgatttgggtcagtttctcaacgtgttgcaccgcacgcaaatctttcgagttcataatgtaagtgccgtgttcatcttcaaaagcggtcatttgctcatccggtttttgcgattcggcaagcaggaaaactttgctagtggtatcgccttcgcctaaggttggtgcgacatttttaatttcaatctgctgttctggatcaatttttgacacgatattgccaacatcatctaccttaccttcttccacctgatattcccagcgacaagcgttggtacaagtgccttggtttggatcacgtttgttgatatagccagataataagcaacgtcctgaatatgccatacataatgccccgtggacaaaaatttcaatttccatatcaggcacttgctcacggatttctgcgatttcatcaatggaaagttcacgagaaagaatgacacgggttaatcccatctgtttccagaattttaccgttgcccagtttactgcgttggcttgcacggaaagatgaatatccatttcagggaaatgttcacgcaccaacataatcaagcctggatcagacataatcaacgcatcgggcttcatatctacaacaacttgcagatctttaataaaggttttgagtttggaattatgcggggcgatattgactaccacatagaattttttgccaagtgcgtgagcttcatcaataccgattttcaaattagcgtggttaaattcgttattgcgaacacgcaagctgtaacgtggttgccctgcgtaaacggcatctgctccataagcaaaagcataacgcatatttttcagcgtgcctgctggtgataaaagttctggtttatgttgtaacatgtggattctctttctgataacaagtcaggactttcccgaaggaaaacgtaaaaaggcgttattctaacggaataacgcctttgggttaagaattatatgtttgtttagtgaaaattctgccattacaagcgatcggtttcgactcaaaatttgcaaattttagagcctaactgaccgcttgtatttaggaggcaaacaggttagacgcccgctttattaagcaaaaactggctcaacaacggcactggtctgcctgttgccccttttgcagcccctgatttccacgcagtgcctgcaatatctaaatgcgcccaagtgtatttcttggtgaagttagataggaataccccagcggtgatcgctccgcctaaacgtccgccgatattggcaaggtcggcaaagttggatttaagctgttcttgatactcttcgcccattggtaaacgccacgctttatcgtccgcttgttctgcagcatttaataagtcgtttgcaagtgcgttatttggtgaaatcaatccgctattgtggttgcctagtgcgatcatacacgcccctgtgagtgttgccacatcaatcactaattcaggatcgaaacgttcgacataggttaatgtgtcacataataccaaacgtccttctgcatcggtattgaggacttcaacggttaagcctgacattgtggttagaatatcaccagggcgataagcgttgccgtctggcatattttcacagcctgcgagtacgccgataacatttaatggcaatttcatttccgcaatggctttcattgtgccatagacagaagccgcaccgcccatatcatatttcatttcgtccattgcatcggacggcttaatggaaatgccacctgtgtcaaaagttaagcctttgccgacaagaacaatcggttttgctgcaggatttggcgatcctttatattcgataattgaaagataagcatcattttcagaaccacgagaaacggcaagataggcgttcatttgtaatgccgccatctctttttcgtccagtaccgtggtagtgatgttatcgtactctttggctaagccttttgctaattcggataaatatttcgggttgcaaacatttggcggacagttcgctacatttttggcgaagatcacgcctgatgcaatcgctttgccgtgttcaaccgcttgttctgccacagttaaatctttgcggttagcgatattaaatacgattttgcgtaattcacggcggatttcaggtttcacgctcttaaattcgttatattggtagccgttttcttgaatggcctcaatcgcaaagcggatattccagtaaacggaacgggctttgacgtgtaattcggttaagaagcagatcgcttccgttgagcctgtgtcgttaatgacttgtaccattttttgaatggtttgtttgtattggcgttcagtcagttcacgctctttgccgcagccaactaacaacacgcgatctgcggggacattgggtacgttgtgtagtaataacgtttgcccaacacgtccttctaaatcgcctttacgcaataaattgcttaaatagccgtcacttaatttatctaattgctccgcagcaggcgataagcgacggggttcatacaccccaacaaccagacagcctgtacgttgtttttcaacagatccgtttttaacgctaaattccataaaatactcccgtgattttttttgtataaaagggtatgattacacattttgcaagcggtgggttttggtaaaattttacaatattatttagcctttgtttgaatgataaagaaaggtagggacacactgcgtgtgtccatatttctggctcaaacatatatttgcggacatatatagttttatggacacgcagctttacggacacacgcagtgtgtccctacaagtgggctattcaaaattttacccaaatccaaccgcttgaacttgcaattaaaatatgggtcataaaactacctgtttgcttgaaaattgcaagcgataaattgtcaaaatgagaactttgtcgtgattttaagtcgatatttaacgaaagaaatatttaaaagccaaattgctatacttttcatactgttagtgatcttcttctgccaacaattagtacgagtattaagctcggctgtgagtggcaaagtccctacagacttagtattgagcttgctcggattaggtatgccgacaatggcacagttgatgttacctttgtcgttatttattgctcttttactcactttagggcgtttttatgctgaaagtgaaattacggtaatgcgcgcttgtggggtggggcagagccttttagtgaaagcagcgttatttttatcgatctttaccacggcagtggcggtttataatgtcttttggcttactccttgggcgattaataaacagagtgaaatgcttgctgaggcaaaagcaaatcctcgctttgctgcattagccgcagggcaatttatgtctgcaggtggctatgtattatttattgataacattaaagataacaccattaatgatatttatgtttttcagcctgaccagcaaaagaaaaataagccctctgtggtggtagctaaatcgggggaactacaagggcttccgaatggtgatcaaatgttaaatttaaccaatagcactcgctatgaaggaacacctcaaacggcagatttccgtatttcgcattttgataattatagtgcctatcttggttatcaagatgttgatagtgatgagaagctggtacaacgtgcagattttcgtaagttacttgctgaaacttccccagaagcaaaagctgagttacagtggcgtttagcgttgattttatctgtgccattgatggcgttgcttgctgtgccgatgagtagtgtaaaccctcgacaaggacgttttgcaaaattattacctgcgttattgttgtatttaatctatttcttattacagagttcgttaaaatcggctggagcttcgggtaagctaaatgtgtctttgttaatgccgatggtgtctgtggcatttttagtgctaggcattattctcaatagttgggaaagtaaatggttttcagcattgcgttatcgtttttcaagtaaaaaggtggtaagtaaatgaatgtattagagcgttatatcggtagaaccattcttgcttccattatgcttaccctatttatgttagtaggacttggggcaattattaaatttgtggaagagttccgttccgttggacgaggtagctatgatggtttgcacgcagcatattacaccctactaacaatgcctcgtgatattgaaacttttttcccaatcgcagccttgctcggttcattaatggggctgggcggtttggctagccgtagtgagttagtggtaatgcaatcggctggtttttctcgcttccgcattgggctagcggtgatgaaaacagcaattccattaatggtgatcacgatgattatgggggaatggggtgtaccacaaacggaacaatatgctcgaaatatgcgatccattgctcaaagtggcggttcaatgctggcgacccaaggcggattttgggcgaaagatggcaatgattttatctatattcgtcaaattcaagatgaacgtaatttaaacaatattttaatttaccaatttgacaatcaggttctaaaatccattaaacaagcggaaaaagcgacctattcggaacaaggctggctcttacagaaagtggataaatcagaaattcacgaaagtggaataactcagactagagaaaccgatcagacgtggaaaacaagcattacgccgagcaagttagggattgcatctttgaggccagagtcgctatctatttcgggactagcggattatgtaggctttttaaaagatacagggcaagatccaaaacgttttgagattacgttctggcgtaaagtttttcagccgatctcaatggcagtgatgatgttgcttgcgatttcctttatttttggtccgctacgcagtagtacgatgggggcaaaaattttgatcggtattctggcaggctttgtattttatgtggcgaatatcgtctttggtaatttaagtcttgttgtttcgtggctacctgtaccgattggggcattaattccaagcttgctctgtttaagtgtggtgtggtggttgttgaataagaaaagggattaaattaaggaaagactatgttaaaaaaattagtattaaagaatttcacagtatttaacgaagttgatttaaatttttctccccatttaaatgttattataggggaaaatggaatgggaaaatcgcacattttaaaattagcgtattctctcattgcttgtaatgcttctgctttttctgtaagtaaaacgcaaatgcaaaagaattatgcagataaattaattaatgtatttagacctgaaagtttaggccgacttgttcgccgtaaacaagggagagagcgttgtgaaatttcagctaaatttgaaaatgacttttataattgtcaatttagttttgcgacatcaagtaaatccgaagttcaaatagatatattacctaaaagtaaaatagagaataatcctgtttttttacctacaagagaattattaacgatttatcctaattttgttcatacttataataatcattatttagagtatgaggaaacatattatgacacttgtttattattaggaaattatttagccaaaggccctagagaggagcgtgcaaaagagctattaaaaccattagaagaggcaatgggggggaaaacggttttagataatgggcgtttttatctttctattcagggacaaggaactatggaaattcctttggttgctgagggattaagaaaattagcgatgattgcgagattaattgcaacaggatctttgttaggtaaaggtgcgttattttgggatgaaccagaggcaaatttaaatcctaaacttattaaaacagtcgctaaggttattttgcaattatgtaataacggtatccaaatttttattgcaactcattcactttttttgttaagagaactagaaatactttctaaacgacaagaatttgctcatttaaaacaattttatttcggtttaaaaacgatagataatggtattgtagttgatcaaggtgatagtattaatcaattggaagttttaacattattagacgaagagcttgaacaatccgatagatttttagcattggtagaataaatgtcagagattgtaattaaagaaggtgatttaacgtttatttttaacgagtttattcttgttgaaaaatatgatgatttatctttttatcgtaatcaatttaatgcttttgcaaatggaaccaaagcagtagatattattgtggttgatgaaaatgataactggatgattgaagtaaaagattatcgacaatatcagagaacgaaaacaataccattagccgatgaaatagcaattaaagttagagataccttggctggaattgttgcgatgaaattaaatgcgaataatcaaagcgaacagcagtttgctaaacagtttttgaagaaaaataagataaagatagtattacatttagagcaaaaaagaagtaattcacgtttattccctcagccgatcgatcctgcaaaattaaaacaaaaattaaagatgttattgaaggcagtcgatgctcatccgtttgtggtgaataaagatagcttacattcgacaatgcattggaaagtcatttaatataaatagaaaataaccattatgtcccaacctcgttttgttcatctgaaagtacacagtgatttctcaatgattaatggcttggcgaaagtgaagccgttaatcaaagcctgtgttgccaacaatatggtcgcaatggcattgaccgattttactaacttctgtggcttggtgcgtttttacggcgaagccttaggatcgggggtgaagccgattgttggggcagatgtgatggttcgccctgaacctgagagtgaagagttatacgaacttacccttttagccaaaaataataccggttatcataacattacccttttactttcaaaggcttatcaacagggctatgtggaatttcctgtggtggaaaaagcgtggctggcagaacataatgaaggcgtgattttgctttcgggcggtagcaatggcgatgtaggtaaggcattattgaaagaaaatcagcaagaagccgaacagcttttggctttttatcaacgttatttccacaaccattattatctttccctttgccgaacagggagaagtgatgaagaacgttatattcaacaagcggtcactttttcgcaaaaatttgcaattccactggtggctgtcaatgatgtgatgtttttaaaacaggacgattttgaagcccacgaaatccgtgttgccattcacgacagttttacgttagacgatcctaaacgcccacaaaaatattcagaacagcaatactttcgttcagaagacgagatgtgtcagctgtttgccgacttgcctcaggcgattgaaaataccttattcattgctcaacgttgtaatgtcaccattcgtttaggggaatatttcttaccgaatttcccgacaggtgagctttccactgaagattttttagtcaaaaaagccaaagaaggtttggaagaacgtttggcatttttgtttcctgatcctgatgtgcgagcaagcaagcggtctgtttatgatgaaagattgcaagtcgagttggacgtgatcaaccaaatgggcttccctggttacttcttgattgtaatggaatttattcagtggtcgaaagacaacgatattcctgttgggccggggcgtggctcaggggcaggatccttggttgcttatgcgttgaaaattaccgatcttgacccccttgaatttgatttactctttgaacgtttcttaaatccagaacgggtttcgatgcccgattttgatgtggatttctgtatggacgagcgagatcgtgtaattgaacacgtttcagaaacctatggtcgccaagccgtgtcgcagattattacctttggtactatggcggcaaaagcggttattcgagatgtggggcgtgtgcttggacacccttatagctttgtggatcgcatttctaaattgatcccccctgaccctggtatgacgctggcaaaagcctttgaagctgagccaaaattacctgagctttatgataccgatgaagaagtgaaagccttgattgatatggctcgtaagctcgaaggggtaacgcgtaatgcaggtaaacacgctgggggcgtagtaattgccccaacggcgattaccgatttttcgccactttactgcgactcttatggtttgcaccctgtgacccacttcgataaaaatgatgtggaatatgcaggcttggttaaatttgacttcttaggtttacgcacgctgacgatcatcaaatgggcgttagagatgattaatcaacgcttggaaaaagagggtaaaccacctgttcggattgaaagtattccccttgacgatgaaaaaacctttaaattattaaaagcagccaaaaccacggcggtattccagctagagtcacggggtatgaaagatctgatttcacgcctacaaccaagtaactttgaagatattattgcgttggtggctttgttccgtccaggtccgcttgagtcgggaatggtgcagaactttattgaccgtaaacacggtaaagagccgattgcctatcctgatgctcagtatcagcacgagtcactgcaaccgattttagagccaacctatggcattatcgtttatcaagagcaagtaatgcagattgcacaggttctggctggctatacgctgggcggtgcggatttactacgtcgtgcgatgggtaagaaaaagccagaagagatggcagctcaacgtgcaacctttgaagaaggggcgaaaaagcaggggattgatggcgagttggcgatgaaaatcttcgacttggtagaaaaattcgcaggctatggctttaataaatcgcactcggcggcttatgcgttggtatcctatcaaaccttgtggctcaaaacccattacccagcagagtttatggcagcggtaatgacttcagagatggataacacagataaaatcgtcggcttttatgatgaatgtatcaatatgggcttaaccgttgttccgcctgatattaatagtggtaaacaccgttttagtgtcaatgaaaaaggcgaaattgtctatggtttaggggcaatcaaaggcgtaggcgaaggcccgattgatgcgatgttagaagctcgcaataaagacgggattttcaaagatctgttcgatctgaccgctcgtgttgatttaagaaaagttaatcgtcgcacatttgaaggattaattatggctggggctttcgataaactagggcctcaccgtgcggcgttgatgaaaaatttagaagatgcccttagagcgtccgatcaacataataaaatggaagcacttggacagagtgatatgtttggcgtgttaaccgaaactccagaagaagttcagaacgcctatgccaacacgccaaaatggacggagcagaccattttagataacgaaaaagccaccttaggtttatatttgagcggacaccctgttggacgttttttgaaagagttagctcattatgcaccgaataaattaaatgaagttcaaccaacctatcgaggacaaactactaccgttgctggattaattatgggggcaagaattgcgacaaccaaaaagggtagtcgtattgggattgcaacgattgaagatcgttcaggtaaaatggatctcacccttttctcagaagcactggaaaactatggcgatctgttgcaaaaagatcagattattatcgcaacaggggcggtgcaacacgatgatttcagtggtggcttaaaaatggcggttcgcgaaatgattactcttgatgaagctcgtagccgttatgcaagaagtttagccctagcgattaaacaagaacagctctcagcaaaatttgtcaaagatctgaccgctattattgagccttataaagagggaacattaccgttacatttctattatcaaagcccagaagggcgtgtattattacgtagtggcgttgagtggcgtgttaccccaaaagagacgatgctgcagaaattaaaagattttttaggcgaaaatgccgttgagttggagtttgagtaggagtaaataatgctacgtataatttatactattctaggttatttagtactacctattatttctcttatcatatggcagaaagaacactctctacctaagcgtcgtaaatgtttgaaggaacgatacggtttttattcatcgggtgaaatcaagcctcaagcaaatggcattgttattcacgccgcttctgtgggagaagtgattgcagctactcctttgattaaagcgattttagcgaattatcctcagttgtctgttacggtgacgacagtaaccccaacggggtcagatcgtgttaaagtagcatttggcaatcgtgttcaccatctttatttgccctatgatttgcccgatgcggtgaaacgttttttagactttgttgaaccaaagttattgattgtgattgaaacggaactttggccgaatttaattcatcaaacccatcaacgccaaattccctttgtgattgccaatgctcgtctttcgcctcgttcagcaaaacgttatggttggattaagccttgtttgcaagagatgttgagtgaaattgattttattttggctcaagatcaggtgagtgcagatcgttatttggggctaggatttaaggctgaacatttggttaatactggcaatcttaaatttgatttagaaatttcacctcaattacgccagaaggtaactcaaacagccgttgagctacatttacttgaccgcccaatttgggttgcaggtagtactcacgaaggtgaggaaaagatgttgttggaagcacatcagcagttattaaagcaatatcctgatttagttctgatccttgtacctcgccaccctgagcggtttgatagtgtggaaaatttactaaaaaatatgggaatgccctatgtaacacgctcttcttttgaacctttaagtgcaggaacgtcggtactgttaggcaatacaatgggagagatgatgctgttttatggcttggctcaggtcgctttcgttggtggaagtttagtcaaacacggtgggcataatccgttagagccaattgcatttgaacttcccgtgatttctggtgtacatacttttaatttccctgagatttttgctaaattaagagaggttcggggcgtgattgaaattcaaagtgatgtcacttcgattgttgatgccgtcaattacttttttgaaaagcctgaacttggacaaaaaattagtcaagcaggggtgagtgtattacaagaaaatcaaggtgctttaactcgtcatcttcaactgttagccccttatttagagaaatagaatgaaccaaactgtaatttatgctggcacatttgatccgataacaaatgggcatttagatattattcaacgcagtagccgattgtttggcaaagtgattgtggctgtggcaaaaaatccctcaaagcaaccgctatttagccttgaacagcgtgttgagttggtacagcaaagctgtcaaatgctgaataatgttgaggtgatcggctttagtgggttgttggtcgattttgctaaacagcataatgccaccacgcttattcgaggtattcgaggggcggacgacattgagtatgaaattcaactggcacagttaaatcaaaaattagcagggcagttagaaacgatttttttacccccagccgtagagtggcgttatctttcttcgacaatggtaagagaaatttatcgccatcagggagatgtggggcagtttgtaccagaaatagttttaaagtctctaaggtaatcgatgaggaaagtgtgtttacatatgatcaagattttaaagagggtagtgtcaatgtagtttagtggatgaataatgagatacgtaaaacaagcagataccagatattcgcatgaatttttagtttacagcctaaaaatttaagggtagaattgcaaaattgctattccatatggatagtaaatgatggtgctgagccttatctcaagccccatccaagaccgtaggtgaacctgtgtgaacagtttcttaatgaaaacaacctacgtagatggtgaacagacagaattatctgcttctgtacaccttagcctcaaaaacgtcgctcaagcggttacttttttgagattttttgtaaattccacagtatttatgtggagtgtatcaggagctaaaaccaatggcattaaatcttcaagacaaacaagcaattgttgctgaagtaaacgaagctgccaaaggtgccctttctgctgttgttgcggattctcgtggcgtaacagtagagaaaatgactgagttacgtaaagcagctcgtgaagcaggcgtttcaatgcgtgttgttcgtaatactttattacgtcgtgcggttgaaggtactgaatttgagtgcttaaaagatacgtttactggtccaactcttattgcattctctaacgaacacccaggtgcagcagcacgtttgttcaaagattttgcaaaagcaaacaaagagtttgaagttaaaggtgcagcctttgaaggtaaaatccaagatgttgaattcttggcaacattaccaacttacgaagaagcaattgcacgtttaatgggcacaatgaaagaagctgcggcaggcaaacttgttcgcactcttgcggcattacgcgacaaattacaagaagcggcataatttttactcgccgtattctcaactcgtttaacttatttactttaggaattgattgttatgtcattaactaacgaacaaatcattgaagcgattgcttctaaatcagtatcagaaatcgttgaattaatcacagcgatggaagaaaaatttggtgtatcagcagcagcggcagcagtagcagtagcagcaggcccagcagaagcagctgaagagaaaactgaattcgatgttatccttgcagatgcaggtgctaacaaggtagcagtaatcaaagcagtacgtggtgcaacaggcttaggcttgaaagaagctaaagacttagttgaatctgctccagcaacattaaaagaaggcatctctaaaggtgaagctgaagcacttaagaaagaattagaagaagctggtgcgaaagtagaaatcaaataatttttgatttagcttttaaattgctagttctatactcaataaaacccgataacaaatgtagttatcgggtttttcttctataatgacagctatgaatactattgaaattgtttttgctccaaatgatgaatttatcccttcagattttttaaattatttggggaatataaacaaatctcttgataagccgtcagcttatcaaataaaaaaatggaaaagtcgccgtatggcttatttcctgttacatcaattatttgaaaaatatcatttagataaaagtttattaactaatatcgttaaaacagaaagtgggcgcccttatattgaacatagcgagattgattttaatattagccattcgggcgattgggttgcgattattttctcttatcaatccccgaaaaaagtggtgggtattgatattgaacacccacaaaaaatacgtcgttttaacgatttattacattattatgccagtgagcaagaaatagctgaaataaataatcatcatctattatcggaactctcttcccttgaaagccgtttttacttaagttggtgtttgcgagaagcggtgcttaaatcacagggtgctggaattataaaactgtcggaagtaatccactcattaagtaaacagcagatcacaaccgcctatagcccaacagggaaactctgcttttatcatcaacttccattttatttggcttatttttttgaccatactcagactatgttatcattaccaaaactgagccaatggaagaatgggaaatatatttcatttgattatcttaacccaattatctatcaagtaaattaaggatagtatgaataaatttaatttagaagaacaacattctcgtttcggaagatttatttctgagagttttcaatggatattaaatctttcactcttagtgataggactaattctggcttactctcttttctatgaagcatattcattaattgaattattttttagccatagtgataaatttcaaattgtagaaaaaattgtgattttcttcttatattttgaatttctagctctcattgttcaatattttaaatataactaccattttccattacgctattttttatatatcggcattaccgcaatggtacgtttaattatcgtagatcactctaatgcaatgcacacattattatttgcattagctattttagtgatgatcgttgctttatatattgttcattcaaaacgcttacataaaagctaaggaatttttatgacacaaattcagcaatttcagcaaaaagatttagagatcttaaaagaagaagtggtttatcaaggccatttcacaatgaaaaaaatgtatttccgccacaagctatttaatggtggaatgagcggtgaaattgtgcgtgaattaatgattaaaggctcagcagccgcattaattgcctatgatcctgtcaaagacgccgtagtgttagtcgaacaagtccgcattggtgcttacgatccaaccagcaaccaatccccttggttagtggaactgattgcaggaatggtagatgacggggaaacgccagaagatgttgctatccgtgaaagttacgaagaagcaggtttaatcgtcagcaatgtggaacacgccttaagcatttgggacagcccaggcggtgcagttgagcgtttacatctctttttaggcttagttgatagcacccaagtcggcggtgtttacggcttggaagaagaaggcgaagatattcttgtccacgttgtgagccgtgagcaagcatatcaatgggttgttgaaggaaaaattgataatgtgattgccgttgttggattacagtggttgcagttgaattatcaaaggtataaagagccacatagcctttcagtacaactgtaatttgatttctaaccgtatggatacaataaatattcaaagggtatagtagacaaagtggctgctaatgaatatttttcattaaagggtgcggataatatagtaaattaggtcgtagaaagagatatagcccatcaataatcctatctttgctactagcggttgcttttgatgtaatttatgcagcaagccagcaatagccaataaaatgaaaggataaatccaaaatgcggtagaaaaccaatcaatttgacttgggctgagattaggattttcgcttaatgcaggtgatacaagcaatgctaatggccataatgaactgggtaaacaaaaaaatgccaatgcccaactaaattttgaaaaaccttgttgcatattatcctcttgggtgaaattgttgatgcagtgattttaaacgagctttcgctacttgggtataaatttgtgtcgtagacagatcactatgtccaagtaacatctgcacaacccgtaaatctgcaccgtgattaactaaatgtgttgcaaacgcgtggcgtaaaacgtgcggagaaagtttattgctatcaatacctgccaacaacgcataatgcttaattcgatgccagaaagtttgacgagtcatttgattgcctaaacggctaggaaaaaccacatctgactgtataccgttaagcagtgaacttcgcccataatcaaaaaactgttgaacccaataactcgcttcttcccctaaagggactaaacgctctttatcacctttaccaatgatacgaactaacccttggcgcaggcttaggttatccagtgttagagaaacaagctctgttacgcgtaaacctgtggcataaagtagttctaacattgctttatcacgcaattctaaaggatcctgagtatttggaatattcagtaaatctaatacctgctcttcactcaatgatttaggtaaatgggctggtttacgcggagatgtaagtgttgctgttggatcatcatctcgatacttttccaaataaaggaaacgaaaaaacttgcgcaaacagctcaacatacgagatgaactcgttgctttatagcctttctccagtctttcgcccaaaaaggtttgtagatcaacatagtctacttttaaaaatgcattgggttcagaaagccattgggtaaaactttctaaatctagtctataagaggctacagtattttctgataatccctgctcttgccatagagtatcaagaaattgttcaataataggatcaagtggtttcataataacgataaaattatcgtaaaaatctgcaaaattctaacataaaaataccttggaaggtcgaccgaaatgaaaaaaccgattagcaaaactaatcggtttatttgaaacatggcaggggcggagaggctcgaactcccaacacccggttttggagaccggtgctctaccaattgaactacgcccctatataattatttacatatagttaaagcgagtaatttactcgcttataaataagtggcggaacggacgggactcgaacccgcgaccccctgcgtgacaggcaggtattctaaccagctgaactaccgctccgcaaattgggtacttggcaatgccctactctcacatggggaagccccacactaccatcggcgtaactgcgtttcacttctgagttcggtatggagtcaggtgggaccacagcactatggttgccaagaaattcttttattaagttagttcactaatttaatgaactaagttaataaaaccccgacgatgctctactctcacatggggaatccccacactaccatcgacgttacagcttttcacttctgagttcggtatggaatcaggtgggacaactgcactattgtcgtcgggaaaatctttcaatgactttctctatcttctttttctgttctttaagggcaatgtaatttgcccctacactattcttattcgaaacaagctgttctctgagttttgtttagtcttttcgtttctatttagctctctaactctctcacgtctacttcaaaaacgcttgaggttgtatagttaagcctctcgggcaattagtatctgttagctcaacggctcacaccgcttacacaccagacctatctacgtcgtagtctccaacaacccttacacacttattgtgtgggagaactcatcttaaggcgagtttcgtgcttagatgctttcagcacttatctcttccgcatttagctacccagcagtgcctctggcgagacaactggtacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattgcactaacctcacgatgtccgaccgtgattagcaaaccttcgtgctcctccgttactctttgggaggagaccgccccagtcaaactacccaccagacactgtccgagaccgcgtttcgcaatcttcgttagaacatcaaacgttaaagggtggtatttcaaggacgcctccacaatcactggcgtgactgcttcttaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgattacaccatcaattaaccttccagcaccgggcaggcatcacaccctatacgtccactttcgtgtttgcagagtgctgtgtttttaataaacagttgcagccagctggtatcttcgactggttcagccttcggaggtatactcctacaacctacgccagcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagcgtggtatcagttacttcatttccgtagaaactcgtcatcatctctcagtgttatggaagtccggatttgcctaaactccccacctaccaacttaaacagacatccaacagtctgctaacctaaccttctccgtccccacatcgcagctttaccaagtacgggaatattaacccgtttcccatcgactacgcttttcagcctcgccttaggggccgactcaccctgccccgattaacgttggacaggaacccttggtcttccggcgaacgagtttttcactcgttttatcgttacttatgtcagcattcgcacttgtgatacgtccagcaaacctctcgattcaccttcatccgcttacacaacgctcccctacccaacagacgtatcactaataatcctctcttcgattactttccgactcaacgttcgggttgcttgaccaacatctctttccgtttcacttcattcgatgttgttaatcgtaaggcgtattagtgatacgcctgatgccgcagcttcggtgctatattttagccccgttacatcttccgcgcaggccgactcgactagtgagctattacgctttctttaaatgatggctgcttctaagccaacatcctagctgtctaagccttcccacttcgtttcccacttaatatagactttgggaccttagctggcggtctgggttgtttccctctccacgatggacgttagcacccaccgtgtgtctcctatgcattactcttcggtattcgcagtttgcatcgggttggtaatccgggatggacccctagccgaaacagtgctctacccccgaaggtattcacataaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactatccgcccagttaagactcggtttcccttcggctcccttattcagttaacctcgctacaaaatataagtcgctgacccattatacaaaaggtacgcagtcaccccaaagggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgttgcaagcttagtaccacaacaaaaacttcgaatacggggctatcaccctgtgtcgcttggcttcccagccaattcttctgtctttgctgctatcactcactggctctttcgctttcgctcgccgctacttacaaaatctcggttgatttcttttcctcggggtacttagatgtttcagttctcccggtttgcctttcattactatggattcataatgaaatgatggattcttcatccatcgggtttccccattcggatatcttggattaaacgcttcttatcaactcatccaagcttttcgcagattagcacgtccttcttcgcctctgattgcctaggcatccaccgtgtacgcttagtcacttaactatacaacctcaaacatttttatctaaaagaaaaaacatttaagactgatattaactactaaacacttaaccgcttttgttcagttaagattttcttactactcagactttcttgtttcagggcaaatatgatttgcccctacagaaaatctctcagttttcagcttgtttccaaatttttaaagaacaattcgataattacttatctttcgacaaaaaaatcatctttaaatggcgtccccacggggattcgaaccccggttaccgccgtgaaagggcgatgtcctaggcctctagacgatggggacatcatttaaagatgctttccttcatgctgtcaatttgcaaattttatcgcaaatctgaccgcttgtgtctgttttcttgctctattccttgtctacaattaccaaacaatctgtgtgaacacttgcaaatctcttcattcaggtaaggaggtgatccaaccgcaggttcccctacggttaccttgttacgacttcaccccagtcatgaatcataccgtggtaaacgcccccctttcagttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagatgcactttctgagattcactccacctcgcggcttcgtcaccctctgtatgcaccattgtagcacgtgtgtagccctactcgtaagggccatgatgacttgacgtcatccccaccttcctccagtttatcactggcagtctcctttgagttcccgaccgaatcgctggcaacaaaggataagggttgcgctcgttgcgggacttaacccaacatttcacaacacgagctgacgacagccatgcagcacctgtctctaagttcccgaaggcacaaactcatctctgagttcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtattttcccaaggggctgccttcgccttcggtattcctccacatctctacgcatttcaccgctacacgtggaattctacccctccctaaaatactctagcaacccagtatgaaatgcaattcccaagttaagctcggggctttcacatctcacttaagtcaccgcctgcgtgccctttacgcccagtcattccgattaacgctcgcaccctccgtattaccgcggctgctggcacggagttagccggtgcttcttctgtgactaacgtcaatgtagtgctctattaaaacaccacccttcctcatcaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatcttatggcaactggccttgcggtcccagtctttcatctcccgatactacgcggtattagctacagtttcccgtagttatccccctccataagccagattcccaagcattactcacccgtccgccactcgtcagcaaagaagcaagcttcttcctgctaccgttcgacttgcatgtgttaagcctgccgccagcgttcaatctgagccatgatcaaactcttcaatttaaaaagtttaatcgctcaatatgtactgactataaaaaatcacgactgaatttattcaatcattatgaatttcaagttaagcacctatcaagacttcaaaattaaaaaatatttttaaacaaagtcaatcaacaagtgcccacacagattgtctgataaattgttaaagagcaaaaaaagaacgacgcactgtcaaatttaactactcacaacagcgcgtcgttgtgtggtgcgaattatagagaaatcctaaaccaacgcaagtactttttgcaaaaaatttgaaaaaaatgatcgcttgttgaaaaataattcagtttgaatgaatttttaacgacaagcggtcgattttcattactttttcacaatacatcaagcaataataaatacattgctctctactgtgaaaagcgatgatgtcgaaagtgttgcaaaatgaatcgcattgccttttccacttccatcactatcgtagcttaatttcccagttgatgaatcatattgaatatgttctatcactttatctgcacttgttaaactactaaagatcgttttggataattcaattttatcttcagcactgaaatcggtaataacatctgccttaccattcaaactagcattgaaaacaaaagtatcctcaccttccccgccaattaatgtatcagcacctaagccgcccactaaacgatcgttccctttaccgccagttaaagtattaccgatattatttgcaataagaatgttatctagatcattgcccgtagcttgtgttgcagtggaacccacgagtgttagattttcgacatttgcggtgagctggtaattaaccgtacttattacccaatccgtgccttgatctacatcttcaacgatcagatctgcatcattaataaaatacagatcatcgcctagtccgccttttaaggtgtccatacctttgccaccgtcaagataatcattgccagctccgccctcgatcatatcatcgcccgctccgccataaatattattatctgcagcgttaccgattaaggtatcattatgtgcagaaccaagcagattttcaatttgcgtaccttgtccaatataggcttgacctttggtgtattccacatttggaatactaatcgcttcattaatctttccgttgttgctatccacaatcgcactttttggcaaatcaaaatacactttgacatcttgtgtattgctattaacagccttaataacgaagttcttttccttagtttcacccacataaatccaagagcctggatttaaattaacatagacccctgcttgctctttagatgcatcaaaggtatcaattcctgcgccatcccaaatataacgaccaccatcggaggcataagtattaaaatcagcaaaggtataaatatcgtctccagcacgagatttcgcattcactccaaagcgattttgtaaataggctaaatcatacatccgcaaggagtgtaacttctgatataaactattatttacataacgattataagacatcaccgaaaactcagagctgtcttcaatcaaatagtctttaccaaattctgttgtggaatcagtgtgtggcatccctaaggtgtgaccgatttcgtgcaatgccgtataataactgtaatcctctccccaactcttataatcatttcctgcattccaagtaatattaccaccactcattgccacagcagcagaaccgttcgtcattttgccaaaattaatcactagactttgtctatctgtaacaggaactaccttgctttctacaaattcaacattaagatagcttgagtattgatcataaacctctctaaaaatctctttcaatctcgtatcttttaacgcatcgcttggaacacttccgcctgtttcaaactccaattgctctgaaccgtggaaataatatttaatcaccgcaggtttctcttgtggcgaacctgccggaacattgtaggttgtaccaaatccacctaaacgtttgacaaaataagccgtgttccaatccgcttgtgaatgatcatcttgcactgtttttggtactggaattagcccaatttttttctcgcccgtgacatcttgtgcaaccccatacacttcctgatcaacaactcggatttttttacccgaaagatccgtagtttctaacgtcgctgaaattttatcactagtagataacagcacttttgaaacttctgcagagaacgttttatctgctaacactttcgttgtcaccgttctatcccctacggtaagcacaactttatccccttcttttgcagtgccaaaaacagagcctttaacaagtgcggtctgttcttgataagcaatggaatactgatccaaattcgtgactttaagataatcccctttcaacgtcatactttttgtcgtcacttcaggcgcatcaatataatggcgatcataaatcccatctcttttcgttagcgtatataccttaggatttggtgtaaatttcaccgaaactgcctgtccatttagtccttttaactcactcgccgcaatatccacaaagaaggttttatcatttacccccactttatattctttgctaccaatggtaatagtagcttgtcgcacttccttataatttttaccctgtgcataaacgccatcaaattcaacttcgccagaaattcgcacaatagggttcttttcttctagagtaaacctaaattcctctagggaagtaagatcgatttgagccgctacatttgcatcaacgaggaaagtttttgccgttgttgccgaattttcacctgcacgaactacagccttaatattgtagtttggcgtattaatcaactctgtcgcagccacattcaagctaaagctcaaatcatttgcaacagtggctttatacactttaccattaatcgtaatttctaccaccgcactttctgttgcagcactgcctgaaattgccccagataatcttattgtttcagattgttctgtcacattaataacattatctgtcgtcacatcatttaaatgaatccgaatatcgccttgtgtcacactataagataagtccgtctgggcaaccccgatattgcccaccgtatctttggtggtataacttgccaatacacttggaacaaggctattcgccaattcagtttcattcatatgaatactaaattgcccatcagcctgaatcactgcagcaacactttttccatttaacgtgagcatcacactttcaccagcgacaaaatcgccggtaactttccccgatacacgaacatcactgctgccattttttgacaccgcattatgctccccaatcgtatctaaagtaatttttggcataggtggagtaacgtccacttgatatgtggttgtattttctgccgttgcaggattgcctgcgagatcacttgccactgccttaacagaaagcttattttccccctcttttgtcgccatttcacttgtcggcaacgttaaagaccagcttttacctgatacattcgtttgatagtctttaccatttaccgttacgataacccgaatatctttttgattaaaatcgctttcatcgtaatctaaggttcccgaaagagcggtcgcttttgccaaatcttttaccacaatggttttaccggcattgatcggatcaatgttcacaccgattgttgcatcaaggtcatagcgatagtccaccttttccgaaatcacaaaacgcttgccactttctttattaaaaatagtcgcaacaacatacatttcattactgtttgcaaaatctgcaacatttaactcagtattaaactctcgcaacacattattactctcacttttacttaaagttgttaaataagtattaccgtttaatttaacctcaactttctcaacaatatccttaccttgaataatggatattccccataccgtaccgcgataaacaaatttttcagttttctcaacaaaagccttattaaaattatttttatctcctacaggttttaaatctgctaagttggcatcacttcccgtatgcactacttgataaaccctagatgtttccgcctcaccgctattgcctgcctcgtccgttgcgaccactttagctcgaatcattttatgattgtcagcagtcaatactgctgtggcaaattcaactttaaatgccccaccaacgactttggttttgaccgtattccaagtggctcccacacaataaggacaaccacaagaaacctcaacctcgctaccatctttcgcaccagttacataacctgtgatcgccgttgttgctttttctgcttcagcactatcaattttgttatctcttgtaatcgggtttaacgtaatcgttggcttatctaacgctgtttcataagcatactctgtactagcggtcatattttccgtattttttaccaccgcactgattttgttatttttagccaataacgcaccgcttactggcagactgaactcgccattatttaccgttgtaatcaaggtttgatcgccaatagtcaatgctacctttgaaccattttccgcacgcgttaccgtccctgacaaggtaatttctttctcggattctgcgatattgacaatattatcttccgtcacagaatggagtttaaccgttaaaggaatttgctcgacattcgcataggtttctgccgttcctcttgcaacatcaccactcacatttaccgtttcaatacttgcagatactttctcgtgaacaatcaaattttttgtattcacctcttttgaaaatctaccgtctttcacttccgcataataaactgactgcccgatctctaatttgacatagtccccatctttcgcatgtttcaccgaacctgaaatagtggttttctctatttcttgttccgcaaaacttaataaactgtcacctgtgatcttatcaaaagtaatctctggctcttgtgccactgtatcaacggtatatttcaactctgcacttgctctgcctcttagtattctttttgtactatgtacagcgttaatcattgctgtaagcgtttgttctccttcaccttttgccaacaacaacggcgtatcaacctctacccaccaaattttatttgttgaatcaacattcactgccataggaggcaatcccgagactgtaattagaacagctccaactgaacctttaacatcataagttcctgaaagtctgacttttccctccacttccgacttactgataataccgtcctcacctccaatataacgatcccaagctattgtcgcgacaggggctttatctgatgcaggttcaatgagtggagctaatgtcggtaacgctggcaaaactactttagacagaggtgttagcactggcgtcggctcaatttcaggctcaactgcaggtttcgattgcggaacaatttcccatgcagatctatcttctgcaggcttaagcatttcttctggctcttccactggtggtttcggctcttccactggcagtttaggttcttctagtggtaaagttgatgagctacgagttgtgctattagatttaaaactctgaaacatacccatgcctacacccaatgttgcagcagaccctaaaacaatactcgctaattgtgctgtgcttaaagaactcgtagtcagtgtggatatttctgccgcactttctgtcgtaacaaaagatgcttgagtttcagctaaaaatggagctggttgactaggataatagagctgatagtcttgtagcacaatcataggctgttcagctccctcaacaaaaacagccaaatcattacctgctatttctgtttttacatccgtcatcaatcgtcctttttcgtctaataactgatatgtggtatttggttctgcctttttaaccaaagttttccccgtttctagggttactttctcaatacggcgattaataatttgtaacgtaatttttgccattactatattctccttttaaagaaaagagcctattaactaggctctttggttgatacattattacacaacaacaaactgaacttgagataactcattaattagaccggttgttgttgcaaagtgaacaggctcatttggaccactcttatcactatcataatacaatttaccctcttgtaatgagataaattcatttacgttatcaggcgtaagagcggtgaaaatttcgcgagaaaattcaattttatcacctggttgtaaatcaatggtatcgattttgccatttaaggtggtattaaatacaaaggtatcagaaccttctccgccaattaatgtgtcagcacctaatcctcctactaagcgatcatcacccacaccaccagttaaggtattgccgatattattcgcaactaaggtattatttaaagcattacctgttgctgcattcgccgttgtaccaataagggtaatattctctacattagtaagagtggttaaatcaaaattaaccgcacttaatacggtatcatcgccttcatctgcattttcagtaatagtatcagaaagattttcaaccacataggtatcattacctaatccgccggctaaagtatctgtaccctcgccaccatctagataatcattccctgcaccacctttaatattgtcgttacctgctccgccgtagatattgttatccgccacattacccgtcaggttatcattatgagcagaccctacaagattttcaatttgggtaccaaagccgataaaggcttgacctttggtgtattcattgaaagtggtgttaccaagagacttccaaagtctatccgtaatcaccgtctcttttggcataccgaagtactcctgtggagtataggttttagcctctttaatcaccaaggtttgttcacgttcttcaccaacataaatccaagaacctggtgttaaatcaacatttacacctttttcttcatttgaggcatcaaaagtatccacaccagcaccgtcccagatataaatatcgccatctagtgaataagcattgtaggctttgaatgtatacacatcattacctgcacgggctgttttatttacaccaaattgatattgtagataagcaatatcatacatacgcaaggttttgaggttatagaataaattgtcttttaccccattgttataagacatattagttagctcaagagtatcttccttagctcggaaggtatttttaaaaccattgcttgagtgagccatatctagggtatgcccaatttcgtgtaaggcggtatagaatgaataattgattgttggtttctcgtaagagatccccccattccaaatgatgttataaccagaccaagcccaagcggcataaccacgaagcttttctgctgcagcaatataaacattagtatcagcttccgcgaccgtatcaacttcaacaaagtttacattaatatatttaccaatctcggcgtaagcagcacggaagtcactgataaattgagaatggaagacatctgctccaatgtagtcttcatatttcgcattgacttcacgactactttcaatattagctggatcagctaactctgccttagtaactatatggtatttatagactaacggtgtgctttctccacctaataccgttttaacagaccctctaattccccctaatttttcaataaaataagggaaattatagccatcagtagagtgatcattattaatctctttcggtggttgattttgtacaataacgtgcttactgcttacattacttggtgttgcaactctctctacatcacttacttggatctccttttcagctaagtctttggttgttaatgttgctgttactttatcggtttgggctaaggcttttttatcaaccattgtcgagaaggtattacccgcttgcactttggtttcatagctcttttcacctactttgaccacaacagtatcaccgactttcacagagctattcgccgctgctgtaacagttccgcttacctcaacctgttgttctgctttgtaatttactttgtagctggtatcagattgtttttctaaatgcggactgtcgaaagtcactttttgtacaattggcgcttctgttccataactgatccaagtcgcataggaaccatcatcttttttggttagcccataaatattgttatggtagtcacccttaacgcctgttgctaaagaaaacgataacgaaacgtccttcccagttaattcagctaattcacttgcaggaatatcaaggaagaattgtttatcgtggaagccagccttataaactttgtcgccaaatttcactttcacttccaacaagcgtttgtgatttaagcccacagcataggcatcagtgaactccacattgcctttaattcgtataagcgggtcgatttcgcctatatttaacgaaaaatcacccactttcttaatatcaatttgagcaacgacttctttatcaacactataagcacgagcagtattggcagaagcattgttattgcctgtaacacttgcttttaccacatatttatcggtcgcaataaaatcgcttgctggaacttcaagtttgaattttaagccatcgcctactgtagcttctttttcttgattatttactacaatttttactttttgtcctgcttgagctgcagagcctgaaatatttcctgaaattgtgacatttgctgatttttccgtcacattaattaaatcatctgctgtaatactgtctaatttaatatcaatatcaccatttttcaggctataagattggctagcatcaaccgttgtgctgttacctacggcatctgtagcaagataggttgcacttactaccatggtaagattatcaactaaaacgtttgttgcgacattgtgagtgaaagtaccatctgaactaacttcaacttcagttgtttggccgttaatcaacagcttcacttttgttcctgcagtcaattcgccttctactttacctttaatcgtaatattgcccgaacgttcatcggcactaattgcattatcgcctgcaatagaatcaagactgagtttgacttcaggcgcaaccgtatcaacttgatattctttttctacagtagcttttgctgggttatccatcttatcttttgcggtaacttcaatcgcgactttttgtgttccctcagcattcgcaagcacagacattggcactttaacagaccaagttttacccacaatttcaggcgtataagtaacaccgccagctgtcagcgtcatactaagatcacgctcacggatatcattttcatcgtaagttaatgccccttttaacagcgtctctttacctaaatctgcgaaagcaattgttttatcttcattaatcgtatcaattgtcgcttgaatttctgctgttacgtcatagacataattaatgtgacgagaaagatctttcgttgcttgcgttgcaggatcaatcactgttactgtcacttttaatttggtaccgttcgcaagatcgctaactggaatttgtactttaaatcttgggtttggattttctagtttataggttttgccgttatttagttcaattgttgcctgagataacttgtaattacctaacccatgtactacgactaaataatcaattacaggattagcatccgcaaaagccttattaattttatttgtatcgtttaggctagttaaattataaggagccgttgaactacctaagctcgcatttgtttttaattctactggctgagtataggtctcactatccgtcgccgttgcactattttctgctgcgtccttagttgttacgctggcttttacagtattcacattagctctcagtaaatctgccgttttaaaatcaactttaaattcaccattgctaacttttgccatcatatcaatccactgcacacctgaacagcttgcacagccacaagaaacagtgacttcttgaccgtcttctacgccagtgaccgttccagtcaccgtcgttaattcatttttagcttctaaacttgtgattttgttatcgcccgtaattggattaagatcaatggttggttttggtgcttctaaatccacttggtaattatgcgtaacttcttgagaaaggactttatttggtgtttctactgttgctttaagaacgctattttttgacagtaaatcaccgcttacaggtaggctaaatttgccttgtgcatcaaccttcgcagtaaaagtttgatccccaaccacaatttttactgttgaattttccggggctttagtaacactaccagtcagcgcaatgtctgattttttagattcatcaatattgatagtattatcagacgttaccttatcgaaggttaattctggcaattccaccgtataattttcactatcgctgacattcgcaatcgttgctgtcacggtttgatgcacaacgagggatttggtatccacttcaatcgcaaaacgtccatctgtaaccggaccagttgatactgcttcccctactttcaacgtaacaatatcaccgttatttgcattagtcacagacccagtgatcgtaattttttcctgttgagattctatataatcaataaggttatcattggtaatctgatctagagtaatttggggtacactattctcaacatgatttgattgcattgatgattttgaggatgaagacgatttactcgtatggtttctaactgtttctgatacaacgccagctgttgccgcagttaccgcacctaaactaagaccaaccagttgtgctgtgcttaatgttgatgcgatacttgtggaagcaaccgccgaaatctcagctgcagctgcggcactttctgctgtagcaaatgaggcttgagtatttgctaaatattgtgcattttctataggataatgtagttgataatcttgtcacactaaactaggttgctgacttccttctaccgaaatagcaagatcgtttccaacaacttccgctttagcattagtaattaaatttccatgttcatctattagttggtattttgttcctttctctgctttttgaacaaccgttttagcaccgttcaaaacaatgtcttttgtttgatggttattaaccactctcaatatcatttttttcattgattgactctcttaagaaaaattgatattcaattatcattgatacgaaatattcccgtacattgatatttgaacactatgggattccgatgttaaaatctgtgcagtataatgctaacttattgaaaaacaaatacaatttataaaaaacatgtatcatattaataggtattaaaaagaactgcctgaataacaaatagttacaatacctatcgttatttctgtataaaatcagtaaaataatatttacatatattgaatttcttggagattaggtatggaaaattctaaattcattggactgggcgttgctggtaattttactgggcatttagaacaagctggagaggatagggattttgtgaaaattcaaactagcgaagttcatcaaccaaaagctatttttcccttttatgttcctagcgaacatctagacaaaaatgaacaatttctttcaacatatcctctctctcacgatatcattgtttttcctgagaaagcagacaatctccaaattgaacctgaagttgcattaatttgtgatattgaatataaagaaggtcgtgtgattgcattaagaccaacacattttgcagcctataatgattgttcaattcgccggcctgatgcccgtaaaatttgcgaaaagaaaaattggggagcccattcaaaaggtatttcttctgtacaaattgcattagataaatttgaacaggggggaaatttagatagctaccacattgcctgttttcataaacgtgatggcaaactttcggaatatggagtagatagtccagttattagctatagctatttccatcagaaattgttagcttggatcattgatagaatgaacaaccaacccaatcaagatccaatgaataatatatctgaactaattaaaaaagcagattatcccaataaagcaattattagtatcggagcaacgtgttacacagattttggaaaaaatcactttttacatattggagatacaagcatagttgttgtatacaacgccaaaaaatattcccacgaacaaatagcctcaatggctgaaaaagaaatctttgtaaacgatgatatttcaccattaatacaaattgttcgataacatcaagtattctatttcctattcgcttgtaccatagccattaagctatttagtccagcagatactttttgctggcgttcttgctcactcagtttaggtttatctcgttcccattgcaaatcatcttgcggtaattcgagtaaaaatcggctgatttcgggtttaattatttcgccatattgacggcgttctttgcataaagaaaaagtcagtgtctgttgtgcacgggtaatgccaacataagccagacggcgttcttcttccacattgtcttcatctatgctggtttggtgtggcaaaatgccttcttccataccgatcaagaaaacgtgtggaaattccaaccctttagaggcgtgtaatgtcatcagttgcacctgatcgctttcgtcatcatcttcgccacgttccatcatatctcttagggtcaaattggtgacgacttgatttaagctcatcggctcgctgagttcatcgccttccaacattttctccacccattcaaacagtgtttgcacattgcgactttgcatttctgcggatttcggggttgctgccgtttcgtagagataggcttcatattgaattttcgccaacatatcctgaattgcagatttcggctcggatctgaccgcttgatcggataattccaccacccagcgagcaaagtcctgcaaggcttgatacggttttggggttaaacgttggatcagttcaaaatcaaaaatagcttcaaataggctcacctgtttttcattggcaagttgccctaatttttcaagcgtcgccgccccgatttcccgtttcggcgtattcacaatgcgtaaaaatgccgcatcgtcatcttggttcaccaataaccgcagataggccaacatatccttgatttcggctttggcaaagaaagacgttccgcctgagattttgtagggaatacggttttggatcagcaacttttccaacaagcgagattgatgattgccacgatataaaattgcataatctttatacttggttttgcgtgaaaaacggtgtgcaatcaactcacccacaatacgttcggcttcttgttcttcatttttcgcttcaatcacattgagcttttcgccttcgcccaactgcgaaaagaggcgtttatcaaacaagtgatcgttgttatcaatcagaatgttggcacagtgcaaaatccgttggctagagcggtaattttgctcgagtttaatcactttgagcttcggaaaatcctgttgcagccgccccatattttcaggctttgccccacgccacgagtagatcgactgatcgtcatcgcctaccacggtaaaattgccatcacaaccgaccaacagcttaatcaattcatattggctggtgttggtgtcttgatattcgtccaccaacaaataacggattttctgctgccaacgctctttagcttcaggaaattgcttaaacagcaaagtcggcaacataattaaatcatcaaaatccaaagcattgtaggctttgagctgattttgatattgatcgtaaaaatggctgaacacccgatcacgatcgctttttgctaaggcaatcgtttgttcaggcgaaagcagatcatttttccagttagaaatggtcgccactaacaacttcagcagatctttatcttccgttacattttcaggcaacagatgtttcaacaacgccagctgatcgtgttcgtcaaacagcgtcatccccgacttatagccgagcaatttatgttcacgctttaaaatctcaaaaccaagggtgtgaaaggtggaaatcgtcaatccccgactgctttccttaccgatagaatgtgccacacgctcgcgcatttcacgggcagctttattggtaaaagtcaccgccgcaatctgcttcggcgaataaccgcaacgggcaatcagatgagcaattttattgatgatcacccgtgtcttgcccgaaccagcacccgccagcacaaggcaagccccattgacatattctaccgcttgttgttgttgaggattgagtttcattgaatttccttttgatataagcggtatgattttagtgattttttgcggattgtcgagaatgatttacctttataatcgctcctatcccctactatttttagagggttatagttataatatctagcaatctagaaaagttgagaaaaaaatatgtacagcaaaattttagcgacgggaagctatatgcccacccaagttcgtacaaatgctgatttagaaaaaatggtagaaacctcagatgagtggattgttactcgctcaggtatcaaagaacgtcgcattgctgcagccgatgaaactgttgcaacaatgggctttgaagcagctaagaaatgtttggaacaggccaatatcgatctgcaagagatcaatttaattgtggtgggaacaaccagtaattctcacgcttatccaagtgctgcctgtcaaattcaaggtttgttaggcattgaagatgcaattgcttttgatgtagccgccgcttgtactggatttgtttacgcattaagtgttgcagatcagttcgttcgtacaggacaagtgaaaaaagccttagtgatcggttcggatcttaactcgcgtaatttagatgaaacagatcgtagcacagtgatcttatttggtgacggtgcaggtgcagttattttagaagcgagtgctgaacagggtattatttctacgcatttacacgcttcccctgaaaaaaatgagatgttagtgttgccttatgctcaacgtggcgataagcaatctggctatattgaaatgcaagggaatgaaacctttaaattagccgtgaagcaactttctgatgtggtagaagaaactttaaccgcaaataatttggaaaaagctcagttagattggcttgtaccacatcaagcaaatttacgcattattagtgcaacagcgaaaaaattagagatggatatggaacaggttgtgatcaccttagatcgttatggcaacaccagtgccgcaaccattcccgtagccttagatgaagcggtgcgtgacgggcgtattaaacgtgggcaactattgcttcttgaagcctttggtggcggttggacctggggttctgcccttgttagattttaatcggtgaaccttaagatgtctgaaaaaattacttttgccgataaaaaacgtaaaaccgttgaacgtgctgaatttactgcagatggtcgctatcttcgtaaagtgcgtagttttgtgttgcgtacagggcgtttgagcgattatcaacgtgatatgatgaataataactgggaaaatctcggtttagattaccaaaatacgccttttgattttgaggcaatttttggcaacggcaatcctgtagtgcttgaaattggcttcggtatggggcgttcactcgtggaaatggcagaacaaaatcctgatcgcaactatattgggattgaagtccacacaccaggggttggtgcttgtattgcttatgcgttggaaaaaggcattaaaaatctgcgagtgatctgccacgatgcgacagagattttgcgagatagtattgctgatggatcattaggtggattgcagctttatttccctgatccgtggcaaaaagcgaaacaccataaacgccgtattgttcaacctgaatttgttacccgtgtattaaccaaactgtcgccgaatggttttatccattttgcgacagactgggaaaactacgccgagcatatgctagaagtattacgtcaatttgatgcttcattgcaaaatacatcagaaaccagcgattttatccctcgccctgatttccgtcctttaactaagtttgaagaacgaggacataagttgggacacggcgtgtgggatttatattttattaagaaataatgttactcaaataggagaaagaaaatggctcaaccaattcgtaatcgcagacagcgtaaaaaaatgcacttagcagagttccaagaattaggctttttagtgaaattccaatttgtagaaggtactggtattgaccaaattgatacaactgttgatcgtttcattgatgaagtaattcgcccaaatggcttagcttatgaaggcagaggttatttgcattgggaaggtttaatttgcttagaaaaattaggtaaatgtgatgaatctcaccgtcaattagtgcaaaaatggttagaagctaatggcttagttgaaatcgaagtgagtgatttgtttgatatttggtgggattatccattactaactcaataaactaatacatagattattatgtgatttaaaagtaatctttgcatgtccctatctcgtttaattattaataatttccgaaatttaacagctgtggatcttgagctgaaccacggctttaacttttttattggagcaaatggaagtggaaaaaccagcctacttgaagcaattttctaccttggtcacggtaaatcctttaaaagtcatattagtaatcgaatcattaagtacaaccaagaagaattcactttatttggcaaaatccaagaagaaaaacacgaatgctctgtcggtttacaaaaaaatcgtcaaggagaaactatattaagaatcaatggggaaagtaataaaaagatcgctgacctagcctatcttcttccaatgcaagttattacccctgaaggtttaacattgctcaatggaggaccaatatatcgcagagcattcctagattgggggttgttccatcaaaatactgacttctatcataattggaatagcctaaaacgactactaaaacaacgaaatgcagcccttgtacaaactcgtcattataatgaactaaagccatgggatgtcgagcttagcaaatttgcacaaatagttagccaatctagggctgtctatgccgaatctattcttacctacattgaaaaaaactgccaattctttttacctgaattagaaattacagcaactttctatcaagggtgggaaaaagaaagagattacgccgatcttttagcacaaggctttgaaagagacagatccgttggatatactatggtcggtcctcaaaaagcggattttcgcttccgagctaacggattaccagtagaagacgtactttctagagggcaacttaaattattgatgtgtgccttgcggcttgcacaaggagagtattttattgctcaaaaaaatcgtcaatgtatctttttaattgatgactttgcctctgaacttgaccctcaaaaatgcgaattactggctgatcgactgtatcaaagcggttcacaagtttttgttactgcaattacccaagaacagctaaaaccaatacaagggaaaagacaggacaatgccacttcattttttatcaaagacggaaaaatgcaatttatgtaggtaggatacttaaatactataaaaatgttcaataatgcttcaatcctttagagagtttctcactatgagcatagtagacaaatttgtctactatgcctgtatttttatgtaaatgctttctttgggtacgtttgactttccattctaagaaaaatatcttttattgaacaatacaaattgctcttcataatgtaaaactatctgcatcaaaaagcccccaaaacttcacagttctgagggcttttccattttaacaacggtggggcaaagcccacctataagtgactactcttcatcatcaccatcaaaccctgcatttaataatgctgcaaggttttgagttgcttcgtcattaacaaagctttgggtttcagcttcgatgtcttccgcagttgcaaaagaagaagcagaaactgccgcttgtgctacgctgatttcttcatctacgctacgacgttttgcacgttctttatgatatgcaaaaccagtacccgctgggattaaacgaccaacgataacgttctcttttaagccgcgtaattcgtcacgtttacctgccacagctgcttcggtaagcacacgggtggtttcttggaacgatgctgcagagatgaatgactctgttgcaagcgatgctttggtaataccaagcaattcacgttcaaattccacttccggtttgccttcagcaacacgtttgcggttagcgattttcacgcgtgcaacttccacttgctcgccctctaagaattcagagtcgtaagcgttggtaattaccgctttacgtaacatttgacgtacgatcacttcgatgtgcttgtcgttaatttttaccccttgtaagcggtaaacttcttgcacttcgtttacgatgtattcagttacagcgtgaacgccacgtaagcgtaagatgtcgtgtggtgtttccgcaccatcagaaatcacatcgccacgttgaaccatttcgccttcgaatacgttgagctgacgccattttggaatcatttcttcgtatgcttcgccttccactggggtaatcactaagcggcgtttacctttggtttctttaccgaatgatacgatacctgagatttctgcaaggatcgccggctctttaggtttacgagcttcgaataagtctgctacgcgtggaagaccaccggtaatatcttttgtacccacagattcttgtggaatacgtgctaatgcttcaccaactgcgatttctgcaccatcatcaagggttacaatcgctttacccggtaagaagtattgcgctggtacatctgtgcctgcgattaagatgtcgttaccttgtgcatccactaattttaatgccggacgtaagtctttacctgcagttgcacgttcacccacatcttgcaccacgattgatgataaaccggttaattcgtccgtttgacgtgttacggttaagccatcaatgatgtcgtggaattggatacgacctgatacctctgcgataaccggcattgtatgtggatcccagttagcaaccacttcgcctgcattcacttctgcaccatctgcttttgaaagcaccgcaccgtaaggcactttatagttctctttagttcgaccgaacgcatcaaccacagttaattcggtgttacgagaagttagtactaacttgccgtctttgtttgtaaccgatttcgcattggtaagtttgatcgttcctgcatttttcacttgaatgctagattcttttgcagctgcagatgccgcaccaccgatatggaatgtacgcatcgttaactgtgtacccggttcaccgattgattgtgccgcaataacaccgatcgcttcaccttggttgattaagtgaccacgagcaaggtcacgaccgtaacatttcgcacacacgccgaagtctgtgttacaggttactactgaacgtactttgatgctatcaactgagttttcatcgataacatcacaaagtttttcatcgatcagtgtattacgtgcgattaacacttcgtctgaacccggttttaatacgtcttccgcaacaacacgacctaatactaattcacgtaatggcactttctcgtctccaccttcaatatgtggagtcatcacgataccttcttccgtaccacagtcatcttcaatgatcactaaatcttgtgccacgtctactaaacgacgggttaagtaaccagagttcgctgttttcaacgccgtatccgcaagacctttacgtgcaccgtgggttgaaataaagtactgaagaacgttcaagccttcacggaagttcgctgtgattggtgtttcgatgatcgagccgtccggacgagccatcaaaccacgcataccggctaactgacgaatctgtgctgcagaaccacgcgcacctgaatccgccatcataaagatgctgttgaatgatgcttgtttctctgggttaccttcacggttgatgacttcttccgtagaaaggttatccatcattgctttcgcaacacgttcgtttgcagccgcccaaatatcgatcactttgttatagcgttcgcctgcagtaacaagaccagagttgaattgctcttgaatttcagcaacttcttcttctgctgcacggataatttcgtgtttttgttctgggataaccatatcgttgataccaactgatgcccctgaacgtgccgcatacgcaaaaccagtgtacataacttggtcagctaaaactaccgattcttttaaacctaaacggcggtaagattcgttgattaattttgaaatcgctttcttacctaatgtttggttgaataatttgtatggcataccttttggcgagatcatccataaaattgcacgacccacggtggtatccactaatgaagttttcggctcaaattcgcccgcttcatttttctcgtattcggtaatacgtacttttacacgtgcgtgcaattctgcttgaccggtacggtatgctttttctgcttcacgagggtcaaggaaatacataccttcccctttcgcattcactttctcacgggtcatatagtataaacctaatacaacgtcttgagatggaacgataattgggtcaccacttgccggtgaaagtacgttattagtagacatcattaacgcacgagcttctaactgagcttctaacgttaatggaacgtgtaccgccatttggtcaccatcgaagtccgcgttgaacgccgcacaaacaagtgggtgtaactggattgctttaccttcgattaagattggttcgaacgcctgaatacctaaacggtgcaacgttggtgcacggttaagcaggattgggtgttcgcggataacttctgcaagaatatcccatacaatcggctcttcacgctctaccattttcttcgccgctttgattgttgaagcaataccacggctttctaatttagagtagataaatggacggaataattccaatgccatttttttcggtaaaccacattggtgaagacgtaagtatggacctacggtaattaccgaacgacctgagtagtctacacgtttacctaataagttttgacggaaacgaccttgtttacctttgatcatatccgcaagtgattttaatggacgtttgttagaaccggtaatcgcacgaccacggcgaccgttatctaataacgcatccacagactcttgtaacatacgtttttcgttacgtacgataatgtctggcgcaactaaatctaataaacgttttaaacggttattacggttgatcacacggcgatataaatcattcagatctgaagtcgcaaaacgaccaccatcaagtggtactaatggacgaagatccggtggaagaactggtaataccgtcattaccatccattctggtttattaccagattgttggaatgcttctaaaagttttaaacgttttgtgatttttttacgtttggtttcagaattcgtttcttgtaactcttcacgcatggtttcgcattggtgttctaaatccatatcgcgtaataacgcttggataccttccgcacccattttcgcatcgaattcatcaccccagcgctcttcagcgtctaagaattgttcttcagttaataactgacctttttcaagatcggtcatacccggttcgatcacgacatagctttcaaaataaagcacacgctcaatatcacgtaacggcatatcaaggattaaaccgatacgggacggcagtgattttaagaaccaaatatgtgccacagggcaagcaagttcgatgtgtcccatacggtcacggcgaactttcgtttgagttacttcaacaccacatttttcacaaatgacaccacggtgttttaagcgtttatatttaccacataaacattcgtaatcttttaccggcccgaagatacgtgcacagaaaagaccatcacgttctggtttgaatgtacggtagttgatggtttctggttttttaacctcaccaaaagaccaagaacggatcttgtccggcgatgctaaaccaattttaattacatcaaaatcatcgtttgatttagattgtgcttttaaaaacttaactaagtctttcacgtttttgcccctgatttgaggtttttgttcttgaaatagtcgcccatttcaactgaaaatctttggttgcaagcggtcggttttggcaaattgtttgcaagatttgaccgcttgtgtgaacaaatgtagggacacactgcgtgtgtccgcaaattttcgttcttacgcttcgtccaactccatatcaatcgctaatgcacggatttctttcgtgattacgttgaatgactctggaatacccggttccatatagtgcgtaccatctacgatgtttttatacatcttcgtacgaccgtttacgtcatccgatttcacggtaagcatttcttgtaatgtataagccgcaccgtatgcttctaatgcccatacctccatctcaccgaaacgctgaccaccgaactgcgctttaccacccaacggttgttgagtaacaagactataagaacctgttgaacgagcgtgcattttgtcatcaactaagtggttcaatttgagcatatacatataacctacggttaccggacgctcaaatttctcaccggtacgtccatcatataaggtaatttgacctgatgttggtaaaccacctaattctaataagcctttgatttcgctttcgtgcgcaccgtcaaatactggtgttgcaagcggtaaacctttacgtaagttttgcgctaaacgcatcacttcttcatcagagaaggtgcttaaatctacagattgtgaaccatgacctaaatcatacgctttttggatatattcacgtaatttcgcaacagattgttgttgtttaatcattgcattgatttgatcaccaataccacgtgccgctaaacctaagtgtgtttctaagatctgaccgatgttcatacgtgaaggaacgcccagtgggttcaacacgatttcaaccggctgaccgttttcatcgtacggcatatcttcaactgggttaattttcgagataacccctttgttaccgtgacgacccgccattttatcccctggttggatttgacgtttcaccgcaaggtaaactttaactacttttaatacgcccggtgctaaatcgtccccttgaatgatcttgttacgtttgatctcaagtttacgttcgaactctttgcgtaactcttcgtgttgttcagcaagctgttctaactgattttgttttgcttcatcttctaaagtttgctctaaccatttctcacgagccactttatctaattctgcttcgctcacgccaccttctactaataagttgcgaacacgagtgaataaaccagcttctaaaatttctaactcttcggttaaatcttttttcgcttcacgaagttgcatttcttcgatttctaacgcacgtttatctttttctacgccatcacgagtgaagacttgaacatcgataaccgtacctgatgtaccgtttggcacacgaagtgaactatctttaacatctgatgctttttcaccgaagattgcacggagtaatttttcttctggggttaattgggtttcaccttttggtgtcactttacccacaagaatatcgccacctttcacctcagcaccgatatacacgataccagattcgtccagtttgcttaatgctgactcacctacgtttggaatatctgcagtgatctcttctgcaccaagtttggtatcacgcgccacacaagataactcttgaatgtggattgtggtaaagcgatcttcttgtactacacgttcagatactaacattgagtcttcgaagttatagccgttccaaggcataaatgctacacggatattttgacctaacgccaactcacctaaatccgttgaagggccatcagctaagatttcaccacgacctactggctcacctaatttcacacaaggaatttggttgatacaagtattttggtttgaacgggtatatttgattaagttataaatatcaatacctgcttcacctgcaacggtttcatcttcattgactttcaccacgatacgagaagcatcaacgtattggatagtaccaccacgttttgcaatcaccgcaacaccagagtcaagggcgattggtttttccatacctgtaccgactaatggtttgtccgcacgcaatgttggcactgcttgacgttgcatgtttgcacccattaacgcacggttcgcatcgtcgtgttcgaggaacggaattaatgctgccgccacagaaaccacctgttgtgttgaaacgtccatatagtgaatttcttctgggcgatataaacctgactcaccgtgttcaccacgacaggttacataagtatcagtaaagcggaagttctcatctaagtttgagttcgcctgtgcgataacgtaagcaccttcttcaatcgctgataagtattcgatctcttcagtcacttgaccattcacaactttacggaatggggtttctaagaagccgtagttgttggtacgcgcatacacagaaagcgagttaatcaaaccgatgtttggaccctcaggggtttcgatcggacataagcggccatagtgagtggtgtgtacgtcacgcacttcgaagcctgcacgttcacgagttaaaccgcctggacctaacgctgaaatacgacgtttgtgtgttacttctgaaagcgggttgttttggtccataaattgcgaaagttgtgatgaaccgaagaactctttcactgccgcagaaattggtttcgcattgattaaatcttgtggggttacgccgtctaaatcacctaatgaaagacgctcacgcaccgcacgttcaacacgcactaaaccgatacggaattggttctccgccatctcgcccactgaacgaatacggcggttacctaagtggtcgatatcgtccacttctccacgaccgttacggatttcgatcagttttttcattacgccgatgatgtcatcattgcttaaaatccctaagccttcgccttccggaatatttaatgaacgattgaacttcatacgacctactgcagataaatcgtaacgatctgcagagaagaacatattatcgaataagccttctgccgcttcttttgttggcggctcgcccggacgcatcatacgatagatttcaactaatgcgcttaagcgatcgtaagttgggtctacacgtaaggtttcagaaatatacggaccgtagtctaaatcgttagtaaatagtacttcgatctctttgtaacctgcttgcgaaaggttcgctaacatttctaaagagatttccatattcgcagggcagataatttcgccgcttgaaagatcaacataatctttcgctgtcacacgaccgacaatatattcagtcggcacttggatttgggtaatattgtctttttctaatgcacgaatgtgacgagcggtgatacgacgaccactttcaacatagactttgccgtttgcttcaatgtcgaaagctgccgtttcaccacgaagatgctcaggcactaaggtcattagcaatttgttgtcttcaatgtggaaagtcacggtttcgaagaacatatttaagatttcttcagtcgtgtagcctaacgcacgcagaataatggttgctggtaatttacgacgacggtcgatacgcgcatacaggttgtctttcggatcgaactcgaaatctaaccaagaaccacggtaaggaatgatgcgtgcgttataaagcactttacctgaagcgtgggttttacctttgtcagaatcgaagaatacgcccggactacggtgtaactgagaaacgataacacgctcagtaccgttgatcacgaaagtaccgttgtcggtcatcaatgggatttcgcccatatagacgttttgttctttgatgtcttttactgtgcctgctgccgcttcgcgatcaaaggtcacaagacgaagttttacgcgtaaaggcgctgcataggttgtaccacgaatttggcattcacgcacatcaaatacgggttcgcctaattcgtaagaaacgtattgtaattcagttgcaccgttgctgctcacaatcggaaacactgaacggaatgccgcttctaaaccttgaagtccttcaggatctctttggataaatttatcaaaagaatcgagctgaattgttaatagataaggtacgttcagaacttgtgagcgtttgccaaagctcttacgaatacgctttttctcggaatatgagtatgccattaaatatagcctctgattttctgtttggttgagttttcacaatccgcctcaagactggcaggaagtggcattataaaaaattgtacgaggtgtcattttccaattgccaatcaaacagtcaaaaatcactactgtaagcggtcaaattgggcaggggatttgcaaattttgttgattaaaatgacaaaatcaacacttgcgttcaagcacaaaaggctgaccactcaaagctgtcagccaatttttacctaaatggttaggaattatagcggattttgcaaagtttggcaacaatttaaccgcttgtttagagaggaattttattagaaaaagctaacaatgatacaaataactccacctaaaaataagaatgggttgatataatctaactctctacccaaattcattgttttttgtctagaactaataagtaaatttaatgtaatcaaaataatacctaaaataaacatctaccctccttacactattgatttcaagttctttggaatgttactttcttttaacccttgagatctaagaatgaagttatgatcttcccctctagtaaccataagcttaattcccctgccttctttttgtatagagatgtcgcaaggaatattattaaccaaagcccaaaagctatatctattatgatcactaatatcagaaccatacttattattagcgtcatatggtcttaatcttaaagcctcatatgcttcttgcactgaaattttagcctcacatcataaaattctcagattttattcctcgtctccgtgcatggtagtactctctatagctcctaataagtatccctatccctcaacaaatgcacattccccttacgacgtaagaagcctgaacggtcgaagtattcgatcagttgcacggtcactttacgcccatattgaatttcatctctaagctgatttaccgaaatttcaccgtgttgttcaatgaaatttttgataagctgagcaaatgcactgatctgttcgtgtaataggaaacggtctttgacaatcggcactaaatagcccaactttcctgctttatatagcaagttacgcatttctgtttcgtctatggatagttcggaagcaatatctctaacccataaggcttgattggttcgttcaaatagcggtcggatttctgcccaaatttgcaattcggcatcgttgaactcaattcgatgtgttggggtatggatccaaccgcgtgtttgtgccaaagtgttatcgacaatcagttcgtcaatgagggcaaaggcaagttgttctgataactctaacgtagcaatacgatgtaaacgagactttgtcactccaagctgatcgctatgttgttggtgatactcttcgagcttcgccacaatgtgttgctggatctgagttttaaatgccccgttaaacaggtgattagagttgagatagtaatccgatttttccgccagtttttctaaatcacgaataaaaatctgctctgcccacagtagttgggtcaaattcaccgctttatgttgcagatagagtgcaatacgttcttgatagcttgtgcagttagctaactgtgagagataactcaagcgtgcttcgctacgtttatggcgttttggcgagtgaatttcgatcacttctgcaccagcaagggtttgactgtcttcgccactacgcaaaataagtttgtcttctaaagcaatgtgcaacggcgtatctaaaatcagttcggctattgctgtatcatcggcagggcattggcttccatctagtaaatttaattttgcggtagtgtgactggcaaagtgatagagatgcacaacactgttttcttttaaagcttgggctgtcgttaggcgaacggtaatgcggtcacaagcaaattggggatcctgctgtgtaatccagtcgccacgttcaatctgctctttttccacattggcgatatttaaggctaaacgttgccctgctaccccgatcgatgcttcgttattttgagcgtgaatgttttttatccgcactttctgaccgcttgagagataaaattcatcaccgatagccactttcccagcgaccgccgtccctgttaccaccaatcctgcacctttcacattaaatacacggtcaatcgcatagcgaaacggtttatctatttgtgtgctttggtgattaaggctgatcagatggtgctttaatggctcaatgccctcgcctgtctgagccgaagtcacaaagaaatgggctgaagccaaaaacggataacgctgttttaattgttcgatcagttgggtagtgcgagtcgcttccgctctgtctgctttggtgagtacgacaataatctgcttaaaattcaacaggcgaagaatagcaagatgttcttccgtctgtggtttaatcccctcgtctgccgataccaccaacaaagcgtgttggataccgccaagccctgccaacatattagacagaaatttttggtgccccggtacatcaataaaacccaaaatatcattttcaatcggcaaataagcatatccaagatcgatcgtcaacccccgttttttctcttcaggcaagcgagcagtgtgagtgcctgttaagacgtgtaaaagtgatgttttgccgtgatcgacgtgtcctgcggtgatgatgatcattttgtctccgagacttctgtttgtttaacggagaagattaagatcttgtttttaaatggtcaaccaatttttctacaacaccaatcacaaagtctttgtctgcttttgaggtattttgtaatagtgtagctaaatattctgcatcatctttattgagtgacgaattgcctgcaagtagatccgccacattacaatgaaagacgttcgcaaattcaaacagcctcattaaactcggcattgccacccctcgctcaatgcgtgaaattgtctcattacccaaatcaagtttttccgccaactgttcttgagttaaaccagtagtttgacgatattttgcaatattgctacctaattgttttgcaaacttctgtttattgatattcatatataccccattaaaatgaggttgtagtgaatataaaactgcccctaagtaaaaggatattaaaagtccataaaaattcaactttttatgttgagttaataaccaaattagatctataattcgaattgcttacaaagcacattaaaaaacattcactattttacaaaaagaggtctttatgaaaaaacttactttatctgtattattagcattgtctactatcagcacttctactttggcaaacgtatatattcaaggagatatcggttcgtcaaaaattacacccgatgatttcaatggaggaacagcaacggattttcgtataagtataggctatgactttggtaattatcgtttggcagcagattacaccaaatttggtacagtttcagaatccgatcaagtatatggagtaaatgttgattactcagcaaaaattcaatctatcggtttttcagcaatctacgatttccataatagtacggcactaacaccttatttaggggtgagagtcggttataccaaagcggatgtctcagtggctgctaatcgtagctattatcaagtttcagccgatagttcaacaacttcggcaggatttggagcacttgcaggaatccaatataaatttacggatcatatcgatttgaatttaggtgcagaatataatcgtttagcttctgacacttcacaatttggcggtaaattaggtctacgctttaacttttaagaatgcgtaatatgaaaaaattactaattccgactctattttcggcttttttattatatctaaacaaagtctagctataataagataaggctcaaaagttgtgtgatctgagccttatttttcgagatcacatttccaatatttttatcaactcttcaaattccgccacacttctcacatctagccacatcttttgttgtgcaaaacgagcaataatcgggtttggataggttttaaactgtttttctaattcaagtaaatcgctctgtttatctgccgaaatagtcacagcaaacgatgggattttttctgtcggtaacgcaccactgccgatttgagcttcactcggttcgatttgcaaaatatagcgctgatctaaccgcttgtagagcgcctcttttaaacgttctgctttctgttgcagaccatcaagggattgtgttagcaagtgcaatgtcggtagctcgtccgttaaacgatcagggaaaagatagtggcgtaacgtagcttctaagcctgacaaaatcactttatcacaacgcaaaacccgtttgagtgggtgctgttgaagttgatcgataaaggcttttttcccaacgataatcccagcttgtggaccgccaagtagcttatcccctgaaaacgaaactaaatccacacctgaagcgactttttgttgcattatcggctcggcaggtaggtttagggattgcatatcggtaagcgagccactgcctaaatcgctaatcacaggcagattaaactcttgccctaatgccactaactcttcttcactcacacttgaagtaaaaccttgaatttggtaattactggtgtgaactttcattaaaaatgcggtattttcgttgattgcgttgcgataatcttttaaatgggtgcgatttgtcgtacccacttcaaccaacttgcaccctgcttgagccataatgtcagggatacggaaagcaccgccgatctcaattaattcaccacgagagataatcacttctttgccttgagcaaaagtcgccaacattagcaatacggctgcggcattattattgaccacgcaagccgcttccgcccctgtcagttgttgcaacagctcagaaacatagagatcacgatgactgcgtttacctgcttcaatatcaaactccaacgccacgttatttcgcattgcactggtagcagctgaaatcgcttgttccgaccacaaacctcgaccaagattggtatgcaaaactgttcccgtcagattaaacacaggtttcattttaacttgagcaaggctttgcaagcggtgagttaattcgttaaaaagcgtatgttccgtttgtagaaagtcaggcagactttgatgttgctgaatatgttggcgagcttgttcaatcagtaaacgagcttgagcaacaaaggcttgatgtccgaattgttgaattaaatcagcaccttgtgatgtttttagcagtttatcaattgcaggaattgaacgaaatagtgattgcatagcagagatccgtcagaaattttgcacaattctaataaattcagtagaatagtgccactttttcggaggtgtgtcatatccggtgatgtggcaggacttcaaatcctgttgaggatgccagcgttctcgggtgggttcaactcccatacgcctccgccaactcaagtttctacacatctctcaacgtaacccaacctaacaaaaatagccttctaataatcgctttctgagtggaatggattgcataacagaattagtctacccttttttctataaaaatctggcaagaccacaagaatagattattactataaataagatattaattaaatttacaagaatattgtcgggatagtaaatagttagataatatttaatcgtctgattatgctattttcactatttgtaatattattactttgtttgcctaaaaaagatgttagaaaatcgcttcaagtcgtaaaaaagcaccgaaatggtgtttacgattttgttttttatcattgtaaaaatgaacttcaggctgaataaacacccaatctttccaaattggttgtcgccagttgatgaaaggtccgtagtgagttagatccgcttttttcttattgatgttaccgccaacaaataaaccatagctcaattttttatagcccgcaaaatcgtgctgacgatacaaactatttccccattcaacattctcatctaaatcacgggtatattgtagaaaggtatgattattgataaaaacctgaggtttccactggaatttattttcaaaattagtgcggagatagtgcttgctttctataccgtatcgataaatttgctctaatcgagtagaaaatacctcattgtgtttccaggttttagctactttgaaacgtaagaatatgtctgtcccagaacgaatccctaaatccacatcagtatcaactcccaatgcttttacgccattagaccaacgtaatgctaaagatgcattattatcacgaacctgtttactgtcataccttttatgtttatccaacggctcacgataattacgatgtagctgattttgatcccgagcttggttatctaaatcttcatcaccaaatacaacactcaaatgctgttttaatgctggcaatttaatcttcccacgaatacgcggttttactgaataaccatcatagcgattccaattgctgtctaacattattcgtatgcctgcagaagcggggttatttggatcgggcgttccaatccaatcatcaatgctgttcgcccagctggcaagctgttcttgcagctttattcgttgatgatctacccaagttgggtttgctttagctactaaaggtaatgcaagcaaagaaaatgcgatgagattatatttcataaaataccttctccatttgggattttaatggaactcactacatctaaaagacaaagcggtaagatttcagctcaatcttaccgcttacattttatctattcaaccactccatataagccttagtcccctctgcaacggttttaaacggcttatcataacctgccgcacgcagtttggttaaatcagcttgggtaaaggtttggtaacgagattttaaatgatctgggaatggaatagtttcaatttgccctttttgatggaacgccagcaccgcatcagcaacggcacgaaaagactccgcattgcccgaacctagattgaaaattcccgaaataccattttgccacgcccaaatattcacctgagcgacatcttccacatacacaaaatcacgcaaaaatgtttccgaaccttcaaatagtttcggattttcgcctttaagaatttgcgtattcaaatggaatgccacactcgccattgagcctttatgctgttcgcgtgggccatacacattgaaatacttaaagccacacactggcgactctgcctcaggcagaattttacgcacatattcatcaaacaaaaatttagaatagccataaacatttaacggctgttcaaattttctctcttcaataaaattgtccgaacgaccgccgtaggtcgctgcacttgacgcataaaagaaaggaatttggcgatctaaacagaaatgcaacagctctttagaatactcatagttgttctgcattaaatatttaccgtcccactctgtcgtatctgagcaagctccttcgtggaaaatcgcatcaatttcgccaaaatcatcgcctgcaataatagaagcaataaaatcttctttatcacaataatctgcaatgtctaaatcgactaaattaacaaacttctcaccatttttcaggttatctaccactaaaatatcggttctaccgattgcatttaacgccttaacaatattgctaccgataaagccagcaccgcctgttacaataatcattgtcttctcctttatttcgcacgctcaatctgctttttcagtttgagcattttttctttgatacgttggcgtttcagttgggaaatatgatccacaaacaacacaccatttaagtgatcgatctcgtgttgaatacaaatggctaacaaaccatctgcttcaagggtaaatgtttgaccttcacgatttaacgctttaacagtcaatttctctttgcgtggcactaaagctcgacaacctggaatagacaaacacccctcttcaatgccagtttctccactactttccaaaatctctgggttaatcaacacgatttgattagttttatccccttcaatatcaatagtaatcacacgtttaagcacattgacttgcggtgcagcaagcccgatcccctcgtgttcatacattgtgtcaaacatattatcaataaaggtatttagttctgcgtccaccgtttctacgggttggcaaaccttagccaaattctcatctgggtaaattaaaacgtctaaaacagccatttttgcgatctccgtcgaaaaattaaaaagaatatgttggctattttaaactttttattaggattagggaaatttaggtggtaaataaggtggaaaataggatttttaatattttgtgaatctcatcgaaaaatagaaaaactctttttatacagtattgacctgtacaaaaataggtctatgataacctgatattttatacagttttaggcgaaatatggaagatataaaactttttgaacaacattctgtgcgtagtcactatgatacacaacaagaaaaatggtatttctctattattgatgtaattgctattttaaccgaaagcatagatccaaatgcctattggcgaaagttaaaacaacgcctaaaagcagaaggtaatgaaaccgtgacaaattgtcacgggttgaaaatgagatcggcagacggaaaaatgcgaatgacagatgtggctgatgtggaacaacttttccgccttattcagtccattcctagtgctaaagcagagccttttaaacaatggctagcaagagttggttatgagcgtttacaagaaattcacgaccctgcacaaagccttgatcgagcaagagaacattggcaaaaaatggggcgaagtgataaatggatccaacaaagaatgatggggcaggaaacccgtaacaaacttactgactattggaagtcttctggcgttgaacaacctcaagagtttgcttttcttacaaacattattcatcaagaatgggctgggcttagtattcaaaagcacaaggaactcaaagggttagatagtcaaaacctacgcgatcatatgactgaagcagaattacttttcacagcattagctgaattatctacccgtcaaattgcggaagtaaagcaggctcaaggtgtagatgaaaatgcagaagcaagtaaacaaggtggcaaaattgctaaaaatgcgagagaagcgttggaaactaagacagggaaatctgtaatcaacgatgaaaattttctacctccaacaaagaaaaagttaaagtaaacaagcggtaggattttgacgaaaatgacacatctcacaaaattattagccctgttacaagtgccacagcttggcgcgcaacgtatcgggcggttactctcggaagtggactttggcgaattttgtcaatacgacaaaaccgcattaaagcaaatgggctggaatgaacggcaaattcagcgttggtttaatcctgagcataaatggattgatcaggcgttacaatgggcagaacaggatcagcaacagattttaaccttatttgacgaagattatccttttttattgaagcagatcagtactgctccccctgtgctttttgtgcgtgggaatgttgaaagtttatcgttaccgcagatagctatcgtcggcagtcgagattactcccactatggcgaacactgggcagggcatttttcggcggaattagtgaaacatcaacttgctgtcactagtggtttagccataggcatagacggattttgtcatcagcgtgcggccaatgaaaacgggattactattgcggttttaggcagtggtttagaccaagtttaccctgctcgccataaaaaacttgctgaacaaatcgttgaaacaagcggtgcgttagtgtcggaatttttccctagccagccaccgattgctgagaattttcctagacgaaatcgtattatcagcggattatcgctcggaacattggttattgaagcaacagtgaatagtggctcgctcattactgcccgttatgcgttagagcaaggacgagaagtttttgcattgccgaactcagtacaaaacccatatagcgaagggtgccataaattgattaaagaaggagcattactggttgaaaatgttgaagatattttagaagcgattgcgtggcaacggcagtcagtgcatattcaaccaagtctatttgatacgaaacctaaacaagcggtgaaatccgaacccaaatttgcaaaaaatctacctgaactgaccgcttgtcagcaacaattatttgaacagattagccttgagccgatcagcgttgatgatcttgccaaagcaacagatatggcggtagaaaccgcattaattgagctgttaaatttggagttgttgggtgttgtgaagcaggtgagaggggggtatgtaatcacttgataataattctcaataatataaaatgagaacctttatcatttaggaggtttatatgccattcattcgatttttctgttttctcaccgcttgttttgcaatttcgacaactgtacaagctaaaaatgaacgagtaatcagcattgggggcgatgtcaccgaaattatttatgccttaaatgcagaacaaaatttaattgggcgtgatagtacaagccttaatcctccacaggtgaaaacattacccgatattggttatatgcgacaactgaatacggaaggtattttggcattaaaaccaactaaagtgattgcgagtgaagttgcacagccgtctgttgtattagaacaactgaaatctgctggcattcaggtggaactcgtaccgcttaaatatagtcctgaaagtgtcgtagaaaaaatcaaacgtattggtgatattgtcggtaagccacagcaagcggctgctttagcagataaatttacccaagaaataaatgcagtcaataaatctccacttgatgtcaatattttatttattctcaatcgagcgggcatacatcaaatggcggcaggaaaaggcacagtcgcagatactgctattcggttaattggagcaaaaaatgcaatgaaagacgccgtgagatttgctccgatttctcaagaaggaatgatttcagcaaatcctgatttaatcgtgcttagccatttgagcttggaaaattttaaatctcccgatgaaatttggacattacctggacttgcacataccaacgcaggaaaacataagcgattagttgttgttgatgatattgcgtttcttgctttcggattaacaatggggcaagagctacaaaaaatgcgtactgcggctgaacaagtggtgaaataatgtcccgttccctttggctgatctcactacttatcgtattgctgcttgtggcacttattgcaacaaatgtcggggcattttctttgacgtggcaagacttaattgcagcagacctaaacagtaatgtgtggcaaatatggttaaatattcgtttacctcgtattttactcgccattatcgttggtttagcccttgcggtttctggcacggtatttcaggggttatttcataatccgatggcagatcctgcattaattggtgtaaatagcggggcaagccttgctgtcgccttctctattctgttgccaaatattttaccaacagcgtggggcatttatagcacaatgctttttgcttttatgggtagccttgctgtaactgggtttatctatgccttaagtcatcgtactcaagcctctatgcaaaaattgttattggcaggtattgcggtaaatgcactctgttttgctattgtcggaatgctgacatatatcagtaacgatcagcaacttcgtcaatttacactttggacaatgggaagtttaggacaagcacaatggcagccgttatttattgcaagtacgctgattttacccgcctgtttatatttgtttactctcgctcagaagctcaatgtgttacaacttggtgatgaagaagctcattatcttggcattaatgtactacaactaaaacgactgttgatgttacttggggcgttattagtaggctctgccgtagcagtgagtggtgcgattgggtttattggtttagtcattcctcaccttgttcgctttaaattaggtgctgatcatcgttgggttctacccgcttcggctctttgtggagcaatcttgctacttgtcgctgatacgtttgctcgaactgcatttgcaccagcggaattgcctgtcggtatgattaccagttttcttggcgcaccttattttctgtggttagtcgttcgttatagggaggtaaattaatgttgcaatcagaccgcttgctgatcgctgataagctcacattaacgattaatcagtgtcttttgttagacaatatctctttagcgttaccacaaggtaaggtgacagtgctgattggtcctaatggtgcgggcaaatccacactgctacgcctattatcaggctacctctcggcaaaaagcggagaagtgcgtttgtataataaaggtatagatcaattctctttagctgaattggctcaacatcgtgccgtaatgcgacaacatagtctgctcaattttcctttttctgtagaagaggtgattagaatgggaggctatcatcgaagccaaacggaagtcgatcagcatttagaagaggtgattacggtgacagaatgtgcggctttgcgagataaggcttatcgacagctctctggcggtgaacaacaacgcacacaactagctcgagcgttgttacaactttggagtgaagatatgcgaggtaaattgctatttttagatgaaccgacctcagcctttgatctttaccatcagcaacactgcctacgtttactcaaaaatctatgccaaaagaaagggctaacggtatgttgtattttgcacgatctcaatttagccgcgttatatggagatcaactgattttactggcagagcagcatatccaagcctgtggcagtgcagcagaggttatccaaaaagagattattcaaaaatggtataaagcggaagttgctgtttttcctcattttgccactcaagctccgcaaatacaactttctctttaaaatgaaagattataccttgacaaaatatagcactcaaataaaacgataattattatcaattaacatgtaaaattgctatgctgtgttcatcaattcgcaggttaatgatgattagcctgttttttaggcatagtagacaaaagtgttggttttaattatttcccctaattattaccaactctttttattcaaaaaatcctttataaacataatcttatgctttttcgttaatccattatgaaccgataatttcggcatagtagacaaatatcctatctaaatcaccgctttcattagatttccgcctattatttctaacttttattgataaacgttgaaaaattcttgttattttatctttagttttgtgtgacccattgttttttttttttttttttacaatggagtgggggcaggtgtttttgagattcccccacttgtgggggaagtagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatgggggcatttgtacatcctgaaaatgtaaataaaggtttatgattttttattaggaaaaacagtagagaaggttattatgaataaaatatttagagttatttggagtcatgttcaacaggcttgggtggttgtgtctgagttagtaaagtctcacaccaaaacatccgcttgcacggataaaagagctcaagtatgcacctcagattattttttagataaacagcaagataaatttaaattaagtcttttaagtctagtattactaggtatattttttagtccagtaggtttagctgcatatcttgaatatggtgctcaagcagtgaatggtggaagccgcggtactattggtattggtatagggagttgggttgggtataattctattgctattggtgatgcctcaaaagctagacctgagtttgctgttgcaataggtccttatgctcaagcaacccatgtcaaggccacagccgttgggacagattcacaagcaggctctcattctgcggcttatggttttggagcactcgcacaaggagcaggctctgttgcgataggcaacggggctacagtaaatgggaatgctagagcaattgccatcggtcagcagtcaaaagctgaaggtcagaatgttattgcgataggttatttagcaaaggcaggattagctggctctgttgtgatgggcaacaatgctacgtgggtagaaggggaaaatttacgtcagtattcaacaaagggaagagggaacgatactgttattatcggtgctaatgcgaaagcagcacatagttcgactgcattaggtagttcagctgaagcaaaagcattttctgcaacagcactaggaagattggctaaagctaaaggagagttctctattgctatagggggggagacagtgacaataatgcagctatagcaaatgggcatgcagcaattgccatggggcgtggttcaagagcgggagaggaatctattgccttaggcagagaagccaatgcggcaactactaaaacagttgtaataggtctacaggctagtgcaagtaagtcacactctgttgttatcggtgcgaatagtaagtctaccgctgagtacggtattgcggttggtggtggtgcaaatgctactggaggcaacgccgttgctcttggtagggactcgaaaggtgctgggacagattccattgcgataggtaatggtgcgaaaacaacaggggcagactctgttgttgtgggtgtcaatatcgatgtgacagatggacaattagtggcaattggacgcgaagcaaaagctggaagccattctactgccttgggttataaagcctctgccgctggtcagcactctgttgctgtgggtgaagaggcaagtacaacaacagacagatcaaccgcacttggtaataataccgttgtcagcgtgggtggcggtgtggcgttgggttatggatctaaggcagatacagctggcggtgtagaggggttaaaacaagctcattctgtcacaacggaaacaagcagcgacactaacggctttaaatccacaggaagtgttgataacaatcctattggtgcagtttctgtgggtaatgacagaatcaaacgccaaatcgtcaatgtggcggctggtacacaagataccgatgcggtaaacgtggcacagcttaaatcgctcaccatgcaaataggaggcgataacgacagtggcaaggtaggcatttggagtggtacgctcactgtaaaaggagaaaatggtattacttcctctgctaatggcagtacgattacggttaaattagataaagacctcaaagataaaattgataagattgccgctatgggtaagttaattcaaagtgcggaaaaagaatcaaatggcaatctaaaaattacctatacagatggttcgcatagcattatccagaaaggtgaaaaaggagatcgtggtgaaaaaggagatcgtggcgaaactggccctgcgggtccagcaggtccaatgggtcctaggggtgagcgaggagaagctggccctgcgggtgcagctggtccagcaggggctaggggtgaagctggtccagtgggtccagaaggaccgcgaggacctgcgggtccaaccggtgctcaaggtccagcagggcctaggggtgaacagggtctaaaaggagatacaggtccagcgggagagccaggcaagcagggtcctaggggagagaaaggtgaaattggtcctgcaggtccaaaaggagaggcaggagcaaaaggcgataagggtgacactggtgaagcaggaccaataggccctcaaggtcctgcaggtgcagctggacctaagggtgaacagggtcctaaaggtgaacaaggtattcagggacctaagggtgacaaaggtgataccggtcagaaaggtgaaacaggccctgcgggtccagtaggtccagctggaccacaaggtgtacctggtcctgcaggtccaaaaggagaggcaggaccaaaaggagaggcaggaccagtgggccctcaaggtcctgcgggtgcaactggtcctaagggggataaaggcgatccaggacaagcgggtcctaaaggagatacaggtccaaaaggcgatagaggcgaagctggtccaatggggcctgctggtccaaaaggagaaactggctctgcgggcccagcaggtgctgacggtacaagcattgttcagaaagatgcagaaggtaatgacttaacaacaaccgttaaagcagatggcgtaacggcaacggataaaggctctaaaaatactgtcaatgcagatggtatgactgttggtccgaaagacgaaaatcaaacggataaatcagctgcgacttataacagagatggtgtaacggttaaaggaaatgacggtgcagatgcaattaccttaactagcaaagaaggtcaagatggtaaaacaactaacaccttggcacttaaaggccaaaatggcaaagatgcagtaagcattacttcgggggcagatggcacagcaccagaaattagctttgctaaaaatggtgagggtacggatgctaaaggcacgggctctatcactggcttaaaagatgttgaacgtaatccggacggcacggcgaaagacagaacggctgcagcgaatacgggctatgtcgatgatcgcttaaaagaaatgaacgatcgaaaaccgtttgagtactttgagaaagattctgtaacaggcgaagtaaaaactgaaactgtaaatggtaaacaagtaccagttacgcttgttcgcggaaaagatggtaaattctataaagagagtgacttaaaagggaaagttttcgatcctgcaacaaatacatataaaaatgcagatggtacacctgcaacattaactgaggttgcttcaaataatgttactgttcaagcaatgccatcggatgcaagcaatacaccaattgcgatgagcaatgtgggaagtggtttaggtttgaaagatgatgctgaatcaaataaaacggcacttacccctacagatgcacaaaaagctattgctggtgataacaaagacggtaaaggcggcttattggctcaaacgggtaatgcgttaaataatgtagcgacagtgaaagatttacaagccattgcacaagcgggcttagacttgacgggtaacaacgccgataccactgtacatcgtccattgggtacgaagttaaccgttgagggtgaaggcaaatggaatggtaaggactcagcggctaataacctttatgtggaagcgcaagaggcagataacaaacttgttgtgaaaatgaacaaggatttaacgaacttaaattctgtgactttaggcactgcgacaatgactggtgataagaatacaatcaaccttactggtgcaggagagaaagtcgaggaagagtttgttaaatgggaccctgtgactaaacaacctattcgtgatgagaatggcaatctccagaaatataaagagaaagttgatcctcgtgtgaaactgagtggtattgctgatggtgatatttcaccgaatagtactgatgcagtgaatggtcgtcaagtttatgttttaaccaatcgtatcaggttcttccacaccaatgatggtcataatgcagaggagcaaattaaccataagtcgaatacagtggagtctcgtgcaacaggttcatactctactgcagttggctacaaagctcacgcgaaaggggagagttctgttgctttaggtaacggggctacagctggagagcaaggcgtggctattggtcacggtgctgtggcgtcaggtaaacaatctatttcgattggtaccggcaatgtggtgagtggtaataactcaggtgctattggtgaccctaatacaattaaagcagatcgctcttatgcattaggtaataataaccaagtgaatgcaggtcaatctgatgtgtttgttgtcggtaacaacgtgaaaaacacaaccagcaactcggtattcttgggaacaaactcaggctatgtggcagcaggtgcaaccactgcgggggcaggtgctttagaaagccaagtaataggtggtgtgtataacgcttatgccggcggtaaagcaactgaagttgtaggcgtggtgagcgtgggtaatgtagacagtaatggcaaaatggaaactcgtcgtattcaaaacgttgcacctggtttaatctctgagcaaagtaccgatgcgattaatggtagccagttgtatagcttaatatctcagcacaaggtgcatatgggcgatattcacaataagatcaaccgtaataataaagctctgcgtgcgggtattgcaggttctaacgccgcagcaggtttaccacaggtttatctcccaggtaagtcaatgattgcagcatcagcggggactttcaaaggtcaatctgcattggctgtgggttactcaagagcatcagataacggcaagctgatccttaaattacaaggtaatgcaaatactagtggtgaaatgggcggctctgtgggggtaggttatcagtggtagatatgataggagcttataacaaattgaccctatcccaaattctgtgtaaacacccatttcaacttaacggtgatcgtctaggcgatcaccaaaatcaatcataaatcgattcattgccagtttccagttctgaatcggcattgtccatttttttgatgcatctttacaagcgggtattttgcctgccatacaaaatacctgtgtctgaatgtattatctcagaaacagttatttacacaaattgtgggagaggctcacccatttagcttcatctcactcaatgtataaaagaattgctgaagcatgctttaacctccttacctctccttacggacgtagcttttcggcatagcgtagtaccccccctattattgagtatccaagttttattcaaagcactaggtattttttctatatgccttttgtctactatgttatatcgtaagtaattacatccttaattttttttaaagcttgattttctaactgtcttaccctttcagcagaaatattatattgagccgctaactcgtgtaaagtggccttattttcatcaagccaacgagttttaataatattttgactacgttcatctagttgtgctaatgcataagctaattgagcagttgcccttccgctatactcttcatattctaattcatctacaaaatttgaagattcatcttcaagatacatggagggaacataattatcatcgtcatcatcccctacagaggtatcaaagcctatatcctgtccgaccattctagactccatttctttgacatcatctgtagagactcccaattcttctgcgacttttctaatttcctcttcattaaaccatgccaaacgttgcttatttttacgcaaattaaagaatagtttgcgttgagattttgttgtagcaacttttacaatacgccagttttttaaaacatattcatgtatttctgcttttacccaatgtaccgcaaaagaagcaagacgaacaccgatctctgggttaaaacgttttaccgctttcattaagccaatgttcccttcttgaattaaatccgctaacggtaatccataacctaagtaacctctagcgatatacacaacaaaacgcaaatgagacatgattaactgcttagcagcatcaagatcttcatcataataaaagcgctccgctaactccttctcttgctcagctgttaaaactggatattgatttgccattctaatataactatccagcgtcgctccctgaggcactaacatattatttgtgatacaaatatttgaagcattattgtcaatatcaactagctctgcatctttagagtcaataaattctgtatcatccacttcgagttcatcaaactttttcattttcaccccttaatctccatatgtatactatcatagagtattgaatgtatatctaaattaatacttgttccttttagctcttggatgagccaaatcgtaaattctcgccaaatactggaaatcaagatgcgtataaatttgtgttgtcgaaagactactgtgcccaagtagttcttgcaccgcccgtaaatcttgacttgcttctaacatatgcgttgcgaaagagtggcgtaatttatgggggtgaaggtgggtatccaatgcttgcttttgcccccattttttcatcgccaactgaatagagcggtgggaaagtcgcccaccacgctgattaagaaaaacggcgttgtcttttgggtgaaactgcccacgtactgcaagccactgttcaattgcatctaatgctttagaaccaatcggcacaatacgttctttgtttcctttaccgagcaatctcacttcacggttaggtaaatccatatcgcctaaatctaacccttgtaattcagacaaacgtagcccagaactgtacatcaattccatcattgccacatctcgtagatcaagcggttcgttactgtctatatttagcaactgcccgagctgttccgcatcaatatgtttaggaagatgcttattggctttaggcgattttatgcctaaggttgggtttacctttaattccccttgcttcaccaaaaacgccaaaaactgacgtagtgccaccaaccgtaaaccaatactttttgcacttaacccttgtttatggctttgtgacaaaatccaacgtaccgtcgatgcatcaagctcttgccaacgagtaacttctgcttgctgtaacatttcgcaaaccactcgtagttggcgttgataattgctgagcgtatgggggcttacttgcttttcaatgcgtaaaaagtcccaatacggttgggtttgatggtaaaggaagttgctcatagacaattaagccaaacctaacttaccaatttttacaccaatattacccagcgcaactggcccaagatattccgccaaaaatttaaacagctcatcaacactatgaaaaatgcaatgggtttgcacttcattttcgactttacgggtaaattcgtagctgactttgttcgcatcaatgtgagcggtgagatttaaataaaccgtttcaaaatagtggctcattgccccttctaaccctggatcgctgatacgtacgtcccactgattactgaataacacttcacttttgactgacattttttacctcttaatatgttgtgttaaatatcgattttatctaaaccaataaatttcgctttcggaaaatgttgttgtaaataatttaataaatagatttctgtattttgactgatcaatgaatcttgatcaagataacgattataaaccagtgattctaaaggaatttgatattgttggcacgtcatcaaactgagtaatgtgtgattaatactgcctaatttacctgaactaaccaaaatgagcgaatactgctgtgtttttaaataatctaaggtggttctcgtttcggtataaggcacagccagtccaccagccccttctaacaaaacataatcatacttttgtcttaattgatttactgcattggtaattttattttcatcaatttccgtatgagctaaacgtgccgctaaatgtggcgaacaaggataaggaaaaacataaggacaagtcaaaccttctttatcttcaggtaataaatcaatgccttgaattttacgatgcactaaaatatcggccgcaattccttcacagccggtttgaatcattttttgcgtaatcacagaaaaaccttgttcctgcaaagttttagcatatacgcccgtagcaatggttttccctacatcggtatcaatacccgatacaaaaatcactttaccaagcattatttccttttttttttacgagccattacataaagtggcgtataggttaatgtcaagcctaaatcttgctgaaatcgcgtacgataacgctgttcaaactgcattagacgattgtccgaccatttagacggatcaataatgcttacccctgttttattcaaatgagttagtactgataatgcacaatcaaaataaaggggaatttcttccattgttaaaacaagaacttcaaattcatcggctaataatttataccattcgtcttcggtgggataagttaatcccgttttaagcagatacttaatttcataaagatttttaggcgaaaatgtattaaacaataaaataccgtcatcattcagtatgttagccgtcttttttaggaagttcgcttcattttcaaaccattgaattgcagaagcggaaatcaccaaatcataacctatgccgaaattttcccgctccgcgtcgccgaagtgataatgtaccgaagaataaggtaattttttgcttaaagcaggctcgtaatcgcgacaaagatcatttagtactaaacattcaaactcacaatgcgacataagttgttcacttaacatacctgtgccgcaacctatttcaagtattttgccaaaagctttgccttgggttgcgagtaatgccatcagcttttgtacgatacattgttgagcaatcgcattattatcatattccgattttgcttgtgaaaatcggatagcgacttgctgtttatccactaactgcacgtcacaccctcaagcagtttttgccaactggaaaagtgattaaaaagataatgctccgcgtcaatgagctgaatttttgtttgtggttgattttgccagtattcaagctgattttgtggcgggataattttatctttgttgccaataatggctttttgccacactaccaatcctgttcgattatcttgcataatacaatcatttaagtgcgctaactcttgttttacttctatgaaatctcgcttttcaggtaacaagcggtaattttctagggcaattttaccgcacattctgcgttcaaattttacaagattttcttcgcttaaagatgaaagcgtaccgtcaaacactgccgttggaataccaaattgatcgtgtttaggtgcccccgttccattgatcgccacagcgtaagtcaaaggaatagcatgtaaaacacgttcagccacccaaacgcctagagaccaagcaaccacataaatttcttgatagcccgaaaaatcaaattcaagatgcaaatctcgataatcgtaacaaatcagtaaatcaaaatcgttcggtaactctaaagatttcgcaatactgattggcgttccccagccagaaaaatagacaagtaatttacgttgttggcgtgtaatgtgttgataacgcacgcttttctccttttacaaacagctaattaagcccattatatcttgttcggttaaatctgcggttaatgagaaacgcagacgagccgtgccttttggcactgttggtggacgaataggtaagcaataatagccttgtttttgcaaataatcggctttttccaccgcttgctgattttcgcctaagatatatggcacgatgcaagtttcgcttagcagcggaaattcacttcttttcgtcacttcagttcgcaagatttggcttaatttctcaagatgatgacgcttttcagtaaattgcggtaattgttcaaataaaaagtaagtccaagcaacattaatcggtggaagtgcggtagaaaaaattaaaggacgcatcgtattgattaagtattctcttatctcgctatcacaaacaagataagcccccatagatgccaatgccttaccaaaagtccccactaaaaagtcaatctcttgaatacagtcgaagacttctgccattcctaaaccttgctgcccgtatacacctatggcgtgggcttcatcaacatacagtagcacattggtataacgttttttgagtgcaactaactgttgaagatccgcaatatcgccgtccatactaaaaacactttccgtaacaataatcacttgttggtagcgctctgaatgtgtctgcaatagctgctcaagatgaagataatcattatgcttataacggaaaaaatccgccccggaaagtcgaatgccgtcaatcaaactggcatgagccaatttgtcagctaaaattaaagtttgtttatccgccaccgcaggcaaaataccgatattggcgtgatagccgctattaaataatagagcggattctcgctgaaaacgttgtgctaatagcgtttcaaaatcctgataaatcgggaaattgcctgttaataaacgagaagatgatgacgtaagcggttgatttttaccgatagattgcaaaaatctttccacctgttgtgcatcatttgccaaccccaaataatcgttagacgataaattcaacatcgtcagaccacgagcaacaacaaattttccctgatgttcaatatcagggaattggcgcttctgcccaatttcagctaattgctgaagatgttgagtaaatttattcatcgtattcctctttgaccacggctaataattgctcggttaaaaagcttaattgtttaggttcgataataaaaggcggcataatataaataagtttaccaaaaggacgaacccaaattcccttttctacaaagcgtttttgtaaagaaaccatattgaccgcttcacgcatttccaacactccgatcgcccctaaaacacggacttcagcaacggatttaaacgctttagccggtgcaagttcagccttgagctgcgcttcaatttgatggactttatgttgccaatcgctttccagtaaaagtgacagagattcataggctaccgcacaagccagtggattccccataaacgttgggccgtgcataaagcattttgcctcgccttcactgatggtatgagcaatatgctcggtagtaatagtcgccgctaatgttaagtaaccgccagttaatgctttgccgatacaaagaatatctggcacaacattggtatattctaaagcaaatagtttgcctgtccgcccaaaacctgtggcaatttcatcaaaaatcagcaatacaccatactgatcgcaaagttctctcgctcgctttaaatacatcggcgaatagaaatacattccgccagccccttgaacaatgggttctaaaatcaatgccgcaatttggtttcctttatgtgcaagcaatgctttcaatggttcaatcgcactttcttgccattcttcatcaaatttaatcgaaggttggggtaaaaaatgttgaataggtaagcggtgacgaaacaaaccgtgcatacctgtaacaggatcgcaaacagacatggcgtgccaagtatcgccgtaatagcctgatcgtacggtggcaaattgatttcgatcttccccttttgcttgccaatattgcaatgccattttcaatgccacttccaccgccacagaaccgctatcggcaaaaaatattttgtttaatgattggggtaaaatggtcagcagtttttccgttaattttaccgccggttcgtgcgtgataccgccgaacataatatggctcattttggctaattgctctgtgattgcattgtttaaacgtggatggttataaccgtgcagtgccgcccaccatgacgacataccgtcaatgagcactcgaccgtctttaaggtaaatttcaacgccctttgcactttcgaccgcataaacagggataggttgggtcattgatgaataaggatgccaaatgtgcttttggtcaatctcaattaatttgtctaaatccattctaccaccataaaaaagccctattttgtgaatagggctttatcatttgttattattgcagtaacgaaatatccgccacctgtaagaacaagttacgtaagttgtttagaattgcttgacggttttggcgaagttttggatcttcggcattaaccatcactttatcgaagaagttatccaccacttcacgtaaaccggctaagcggtcaagtgcggtttgatattcgcctttttcaaacagtggcgcaagctctgcttgtaatgtaattacttgttctgcaagggctttttcttccgcttccactaataaagtgcggtcgatttctgatgaaattttgccttctactttcgctaaaatattactcacacgtttattcgctgccgccaatgcttctgcactatctaatgtacggaaatgcgacaccgcacgcacacgagcatcgaagtctgccgggcgagttggacggcgagtaagaaccgcttggattacgtccactgcaattccttcatcttgataccacgcacggaaacgaccgagcataaagtccaccacatcttcaacaacattggcgttcgttaatttatcgccgaaaagtgcggttgattttttcacaatttcagcaagatcaagcggtaaatttttctctacaataatgcgtaacgcacctaatgccgcacggcgtaaagcgaatgggtcggcactgccttttggcgcttgaccgataccaaaaatacctgtgagcgtatcgaatttatccgctaacgcaacagaacttgccacaagtgatttcggtaactcatcgcctgcaaagcgtggcatatattgctcgttcaacgccaccgccacttcttcatcttcgccatcgtgacgagcatagtgcatacccattacgccttgcgtatcggtaaattcaaacaccatattggtcattaaatcacattttgacaacaagccggcacgtttcgccttggtttcatcggcaccaatttgttttgcaatttcgcctgcaagttgttcaatgcgagcggttttgtcacgcaaggtgccaagttgttgttggaacaacaccgtttctaaacgtggtaactgatcttccaaacgttgttttaagtcggttttgaagaagaattccgcatcggtcaaacgtgggcgaaccactttttcgttcccttcgatgattttgcttggatcttcaggattgatgttagacacaaagataaagtgcggtagcaatttgccgtctttatcataaatcgggaagtatttttggtcgcctttcattgtgtaaactaaggcttccgcaggcacagcaaggaaacgctcttcaaattttgccgccaacacgtttggatattccaccaaagacgtcacttcgtctaacaactcttcttcaatatccgccacgccacctaaagcggtcgctttttcttgggcttttgcaagaattaacgctttacgctcgttgaagtctgcaaccactgagcctttttctttcaacaacgcagggtattgatccgcgtggctgatttggaactcacgctcgcctaagaaacggtgaccacgaatagtcgtaccgcttgcaatacctaaaatttcgccttcaatcagctcatcgcctaacaataaggtcacagtgtgaacaggacgcacgaattgctcggttttatcgccccaacgcattgttttcgggataggcaatttcgccaacgcattgctaatcataccgactaacaagtttttggtcggctgaccttcgatcaccgcacggtgaaccagccattcgcctttatcggtggcaatacgttccgcctgctcaacggtaataccacagcctttcgcccagccttccgccgctttggtcggcttaccttccgcatcaaacgccgccgacaccgccggaccacgcttttccacttctttgcttggctgactagtcgcaagccccaatactttcaccgctaaacggcgtggtgccgcaaaccattccactttgtcaaagctcaaacccgcttggtttaattccgcttcaacattctccgcaaacgcggtcgctaattttttgagtgccttcggtggcaactcttctgtgccgatctcggcgaggaagttttgtgttgtcattttgttttttctctttaaatttaaccttttattttgcttattaattctctcaaacagaactacattattcgccttttcaacgccaatttaattcggtacgcagtgagacccgaatttgcaaaatctctatcaaattttaccgcatcccccatactaacgtatggggttacgcatagtgcggttgctccgcaacctattttacttgtcgcagagcgacaacactatatttaacctattacgtcagtgctagggctaactcagctaaatccaacaccactctctcatcttccaacaccaacgcaggaatgccgatatagccattggctttgacgtgatcaaatgcagggtggttatcgcgaagttttaaaaaagcttttaaatttgcaccgcctgtagtcatttcgcgttcttcgtagtcaataccaagacgttgtaattcagcgacaaatggggcggtgtcaggacaccagtgggcgaaatataaaactggtttttgcataatttttcctttgtttaagggcaaatgtcatttgcccctatcaataattattttttacaacctgggaaccctaacgcttcacggcttgcatagtaggcttccgctacacctttggttaaggtgcggatgcgtaaaatgtagcgttggcgttcggttacagagatcgctttgcgtgcgtcaagtaagttaaagctgtgtgccgcttttaagatacgctcgtaagctggcaacggtaacggtttttctaatgccaataattcttgcacttctttttcgtattgatcgaaacagtagaataagaaatcagtatttgcatattcaaagttgtaagtagattgttctacttcgttttggtggaatacatcgccgtaagtggttttgccaagtgggccgtccgaccaaacaagatcgtacacactgtccacgccttgaatgtacattgctaaacgctctaagccgtaagtaatttcgccagttaccggtttacactctaaaccacccacttgttggaagtaggtaaattgtgtcacttccataccgtttagccacacttcccaacctaagccccacgcgcctaacgttgggttttcccagttgtcttccacaaagcgaatgtcattttgcgttgggtcgaagcctaacattttcaagctgtctaaatagagttcttgaatgttatccggtgatggtttgattaccacttggaattgatagtagtgttgtaaacggttcgggttttcgccatagcgaccgtcagttggacgacgtgaaggctgaacgtaagcaaacgccatcggctcagggcctaaagcacgcaaacaagtcatcgggtgagatgtccccgcgccgacttccatatcgaatggttgaaccacggtgcaaccttggtttgcccagtaatcttgtagggctaaaatcataccttggaaagttttcacgttaaatttcgctgtcattgtctttttcctaaaaattcattcaaaaatgttggctattataacgtgtaagcgatgaaattttgggaattttttgaaattagaagaaatatctttactgttacactttatccatgattcacatacgaactattaagaaaataaccctatagtaaggagcattcaaatcaaactagaagaagcatctgcatcgtagcgttgtttgaacatctccacaatatatttatgctgattatttgaagagtcagaaggagctctatagtggtacattaatatttgagtaccttatctgagggttgcaggtgctaaataaatagagggtgagagtggaaaaattctaaacagatctcaccactctttcaaaaagttagctattgaaaagctacgctgattgtgaatttatacaaattccttaataaaacttaacaagttccccacagatcatattcatctgcttgggtaatggttactgaaataatttgacctactttcacttctgcacctgaaaggttatctacatagacaacgccatcaatctctggggcatccgccattgagcgaccaattattccttcttcatcaatttcatctacaatcactgacaaggttctgccaattttctgttgtaaacgatctgccgaaatttgttgttgtaattgcataaagcggtggaagcgttcttctttcacctcttctggaacttgatcttccatttcagttgcaacagcaccatcaacagggctgaatttaaaacaaccgacacgatctaattgtgcttcttttaataaatccaataacatttggaaatcttcttccgtttctccagggaaaccaacgataaatgttgaacgcagggttaaatctgggcaaatctcacgccactttttaatgcgttctaatgtgcggtcaatagatcctggacgcttcatcgctttaaggatttttggacttgcatgttgcaatggaatatccaaataaggcagaagtttcccttgagccatcaacggaataaggtcatcaacgtgtggatacggataaacataatgcaaacgtacccaaacacccattgaacctagttgttcacagagggtgatcaagttgtttttgattggcataccgttccagaaaaccgttttggtgccttcttcttttttcttatctaaagcgtatgcggaagtgtcctgcgatacaatcaacagctctttgacaccagaatccactaaacgtttcgcttcatctagcacttgtacgattggacgactgtctaaatcaccacgcattgatggaataatacagaatgtacaacggtgatcacaaccttccgaaattttcaggtaagcataatgtttcggggttagcttaatgccttgttttggcacaaggctgacataagggttgtattctggtttaggcacatatttatgaacgtgtttcatcaccgcttcatagctatgtggtcctgtaatttccaagactttagggtgaacttcacgaatttggttctcttttgcccctaagcagcctgtcacaatcactttgccgttagcttctaatgcttcgccaatactttccaaagactcttgcacggcactgtcaataaacccacaagtattgacaatcactaaatccgccccttcgtagctggaaatgatgttataaccatctgaacgaagctcggttaaaatacgttccgaatcgactaaatttttagggcaaccaaggctcacaaagccgatatttggtgctgaactcataaaacaatctcaacaatatagataatcaaataaacaagcctatgcaaagcataggctaaaggaacagaattgtacaaaatttgaagataaatttcgacaacaagcggtttttttatggttaaaatttgcaaatattacgagataaattaccgcttgctgtcttgattaggcaaaattattcaacattgccaacacaatttcagacgatttttctgcagcaagcggtaagaattcatcaaaagagagatgagattctttgtctgccacatcagaaattgcacgcacaacaacgaaaggcacttggaatgcgtgacacacttgggcgatagaagcggcttccatttccacggcttttacggacgggaaatcattgcgaatacgagcaatcatatcactgccattcacaaacagatcgccactacagattaaaccagatactgcattaaatcctgctttctcggtttctttgatagcaatttgtgcaagttgttcgtttgccataaaggcggctggattagctggcagttgtcctttttcataaccaaaggcggtgacatctacatcgtgatgacgaacttccgttgaaatgacaatatcgcctacgttcaaattagcgtctagacccccagcagatcccgtattaatcaccatttcaggtttagccagttgtaataataatgccgttcccattgcggcggcggttttaccaatacccgattgcaataatgcaacatcagtattattaattttgccttcgtagattttacaacctgcaatttccgttaatttcggctctgccatataacttaataaaatttcgacttcttgtgccattgcacctatgatgccaattttcattttgtgactccttgttgctctttttgtaatttatcgactaaaaagtcgagtacggcgtaggtataatcatcattataaagagtacttttagttaaaatatattcaccattcaataccgccatgggaatgactggcggtgaatagcgttttattaattcataattttgtgagattcttttcggataattttccttttttcttgtttgttcaacggcatccaacgaaatctgattcttatgcaaccatttggctattgcttcatcattggtaataagtcgatcattttgataagagctatcaaataaatacttctcacttaattcaggttttcccagttctgaaaaaagtgcatttaaacttactgtgatgccatatttattctcactaaaagcggcaacacgttctaaaaccactttatctgagtgtcgagaagcgtattgttttaaataatcatcaccatttaaacagacttcacaaccatactgataaaaataagtaattaacaccttattatctttcggtaataaaatatctaatggttttttataagagtagtagccttttccatcttggaatagaggtgtttttgtaggttcttctgcaaaaagcgaagatataaatagccataagctaataaaatagatccaatttctaaatttcattatgttatccattgaacaaaatcactaaatatcactctaatagtgcggtggtggtgtttcttctgcacgacttgcaacattacttggctgaacactgtgcaatttttcagctaaatgacgcacttggtactgcagtttttctagcataaactgttgggcaatcagagcttgattaagttcctcgattgtatgatcttggaaggcgattttagcttctaactccgccaaagaggtagttatcttattgaaattttctgacatttcaaaatataaaggttgtgttaaaaagaaatacactttaccctatctacctttgttttaacaaactatttaatgatttttacaaggaaaagctatgttaaaaaataaattttctgctcttgcagtaatgacaagctctctgtttattgcacaagctgcgtttgcagaaaaagcagatactaaatttgttgatgattcatcttacgctgtgggcgtattgatgggtaaaaatatcgaagatgttatttcttctcaaaaagagattttttcttataaccaagaacgtgttttagctggtatgcaagacacattgaaaaaaagcggtaagttaaccgatgaagatttacaaaaacaattaaaagcgttagatgcttatttagttgaacaagaaactaaaatccaagcagaaaaaagtaaagcgaccattgaggctggcgataaattccgtgctgaatatgcgaaaaaatccggcgtgaagaaaactcaatctgggttactctataaaattgagaaagcaggctcaggcgaagcaccaaaagcaactgatacagtaaaagtacactataaaggtacattaccagatggtactgtgtttgacagctcttacgaccgtggtgagccgattgaatttcaattaaatcaattaattcctgcgtgggttgaagcaatccctatgttgaaaaaaggtggcaaaatggaaatcgttgctccaccacaactggcatacggcgaccgtcaagcaggaaaaatcccagcaaactccacattaaaatttgagatcgaattattagattttaaaccagcaaaataagtttacttaaactcattctaagggcacaatttgtgcccttattttcaattttatgtagcgacaaagtatgacagcaaaattcaacccgctttctgatgaagatcacgccattttggcttcctactttcctgttgttgatggtattgccgctctcattggcgagcattgtgaaatcgtactgcattcccttgaatttttagaacactctgcgatttatatcgtcaatgggcataatactgaccgtaaaattggctcgccgattacagatcgggctttgtggtcacttcatcatatgcaaaccgacagcgtatccaaaccttatttcactcgcgccaagggtggagtattgatgaaatctgtcaccattgccattcgcaacggtaaacaacacgttatcggcttaatttgcattaatatcaatcttgatatccctgtatcgcaatttttaaatagttttattgccccaccagagagcgaaggctcagtgaattttgcaagctctgtcgaagacttagtggctcaaaccatcgaaagcaccattgtcgaaataaaaaacgaccgcaacatttccaacagcaataaaaaccgccatattgtcaccgccttatttgaaaaaggtatttttgatattaaagatgcaatcaaccaagttgctgaccgcttagagatctctcgccacacggtttatctctacattcgccagctcaaacaggacggtgaataatgcgatatgtgttggcagtaaaacacggggtgtatggctcacaaggggcgtatctagcctatcaagttgctcaagcacttttagatcaggggcatagaattgaacaaatcttcttttttcaagatggggttagcaatgcaaatcaacttattgatccagccagcgatgaactgaatttggttgaggcttggaaaagcttagcccaatctcaccgcttgtcgttacatctctgtattgcagctgctcaacggcgtggcattgtagagcaaaatctcgctgaaggttttacccttgcaggtcttggtgaatttagccaagcggtatttactgcagatcgattactgactatttaaaatgaaacgttataaacttgctattctctttactcagcccccatttggcacatcaacaagccgagaaggtcttgatgctctattggctgccagtgctttttgcaatgaagatgaaattgccatttgctttctcaatgatggcgtattcaatctagttgctaatcaacagcctgaaaaaattttacaaaaagatcatatatccacattcaagctaatcgatctctatgatttaaccgaatgttttgtctgccaacaatcagtagatgagcgtgggctacatcacgcagaatggatactacccgaactccgttttgttagccgaacagcattatttgataccctgcatcaagccgaaaaagtactcacattctaaggacatactatgctctatacgttttccaaagcacaatatgacttatcaacactaaacgctattcttgaacaagttacccctgatgatgccatcgtgttatggcaagatggcgtattacaagcggtaaaatacccacaactttttaccaacaagacagtttttgtgttacaaaatgatatagaggcaagaggattaaccaccacattgccaacaatctcgctggcaatgttggtgcaattgacggagaagtactatccgcaagcatatatttaataatatagttgttactctagtactatcaatgcttctcttctactctcaatccataagtggaaaattttcctaaaacgactttaatttcttcatcagaaaggactgggacatctggtgtcgttgccaagagtttcagataccattccgctaaaacctcaacttcgtgagcaacccaaagggctttttccagattaacttcagcagcaatcattccgtgatgttgtaataaaatcgctttactttttgcgataccttgttttacatattccgcaagttgccaagtaccgaaagtagcataaggcacacacggaacgtgatttgttcccgtaacgccaatcatataatgaatagctggaatatctttatttaagatagatactccagtacaggattagtgtaccactacaagcaccgttttcacccattaaagcgtgggcttctcccttatgtagttcaagctgaacattctttagggcttgaactcccacaaaagatttgctgatgttcttcattgagagtaacggcgtattgctattgactgcggtcatctctgcctccattacaataataaaaatggtttacctaggtaacggaaagcatatttgtacaaagttgacagttttcaaagtggatttacattgagatgttaattttgtgaaaggtgtcacaaaaaatcatttattgattattttttcacaaaaagaacctgcccgattttttgaaaaatgtaggaaaatcgggcaggttaaacggaaagatattatatgtttcagtagagtatctatttgaatttctcactataagccatactgtttacccaagcatgatcgctttcccacgtaaattgccatttacgaacaggtcccgccattacatttaagtaataattgttgtaacctgcgattgttgccacagggtgatagcctcttggtactttcacaacatctttatcataaaccgccatacattcatctaagcttctatcatcagtataaactcgttgcattgcaaaaccttgtgcatgctcaaaacggtgataataagtttcctcaagataagtttcatttggagaatctttttggtcgtgcttgtggcttggataagaactcgtattgccttcatcagtaaagacttccacaactaataaactatcagcaggctctgtttcaggtaaaatattatgtactaatctttggttattaccgacccctcgtttttctacgcctatctcttgtggcttaattaagcgtaatggtaaatcaccattacttggagcacaacaaacagccagttctaaatcttccgtagcaacaacttttagttggtaatgatgaggaacatataaagcataaggaggaatcttttcaaaaggtgtagacctattcccaatattttcaaaaacttctgttggggtgattacgttgcctttccctgcaacaaatactagacagagttcatttgtcccactctctaatgtaatttcttctcctttactcaaaaggtaagcatcaaaacctacatactcccaatttgcgttttctggtgtaatgtgctggatttgtccgtgtttttgactttttgacagtaaatagctcataaatacctcacattaaatattattgacctaagtttgtactataaaaaatatctacacttttttgtattagaaaatgctcatttttctatacggatcacaaaaatgaaatatatttttcattttgatgatttttagcttgaaattttctttttttagaggtagctttgcaccgttattgtctagaattccttctactttatatttcaaaggagcacacatatgagccaatttgttcagaatttcattaatggtacaaaagtagagagtgccagctctcgtttttcgtctgtatttaacccagctacaggggaagaaatcaaaaaagttaagcttagtacagtagcagaagtcaatcaagctattgaagctgcagataaagcatttcctaactggtcgcaacagtccccattaagacgtgcaagaattttatttaaattcaaagagttacttgaagcaaactttgatgaattagctcgtctaattacaacggaacatggcaaaatttactctgatgcaataggggaattaactcgtggtttagaagttgttgagtttgcaacaggtatccctcacttacaaaaaggggaattttcagcaaatgctggacgaggtattgatattcactcaatgcagcagccattaggtgttgtagctggtattacaccatttaacttcccagcaatggtgccgatgtggatgttccctattgctttagcttgtggtaacacttttgtattaaaaccatctgaaaaagatccatctgtatctattcgtttagctgaactattaaaagaagctggtttacctgatggtgtattcaatgttgttcaaggtgataaagaggctgttgatattttattaaccgaccctcgtattcaagcagtcagttttgtaggttcaactcctattgctcaatacatttatgagaaaggttcagctcatggtaaacgtgtacaagctcttggtggagccaaaaatcatgcattaattatgcctgacgccgatattcaaagtacagcaaataccttacttggtgcagcatttggtgcggcaggtgaacgttgtatggcactttctgttgctgttgttgtgggagatgaagcagcagataaacttgttgaagccttggtaccaaaagtacaagcattaaaaattggaccaggaattttaccagaaggtcaacaagaaaatgatatggggcctgttatttcaaaagaacatagagcaaaaatcatcagctatattgatcaaggcgtagaacaaggagcgaaactttgcgttgatggtcgtccgtataaagttgcaggtcatgaaaatggctactttgtgggaggaaccttattcgacaacgtttcaaccgatatgactatttataaagaagaaatctttggtccagttctttgcgttgtacgtgcgaaagattatgctcacggtatgtctattattaatgggcacatttatggtaacggtagtgctatctttacaagtgatggagatgcagctcgtcaatttacccaagatgtacaagcgggtatggttggagtaaatattccaattccagtaccgatggcattccactgtttcggtggttggaaagcttctatctttggtccattaaatgtgtatggtagcgatggcgttcgtttctatactcgtatgaaaaccattacaacacgttggccagataatagtgtgagatcacaagctgcctttagtatgccaacactataatctctctcaattctaacactataaaaaaatagcctaacttcaacgttaggctatttttttcccaaaaacatattctctaaatttttatcatcatcaaaagtctataacaaaaaatttacataaaaaacacgatctaattcacaaaattaaaatctagtcgttgcctacataaatactaaatgttatacatacacttagacaatttatttcaaattgctggattttgaaatttatattcacaataaatttcttatgacattgtgcaatatagtggtatttcagagatttcgttattcgatcaacctttaaggagtggcttatgaaaaaagcattattagctgttttatgcagtggtttattactttctcaaacagcatctgccaaaaatattgttattggtgcaccaatggctgcatttgcagataaatggcaaacctatttacaagagtctgtaagagattttgatgcaaaacataatgacgttgaaattaaacttactgatgcaaacggtgaccctgcacgtcaattaaatgatgttgaaaactttatcgatcaaaaagttgatgcattattagttgttccaacagatccacaaattgtgaagagaattgggagattagcgaagaaagcgaatatcccgttaattgttgttaaccgtaaaccaaacgatgaagatatgcaatatgttactagctatgttggttctgatgaaattgaagctggacgtattcaaggtgattacattgtaaatgctttaaatggtaaatctgcagaatctttaatcttaatgggtattcttggtttagatgcaacagccaaacgctcagaaggagtgaaagaagtctttgctagaacaggtaacgttaaagtagtttctgaacaagaaggtaaatgggaaagagatagaggtctcaccattgcagaaaatgtgcttgttgctaacaaaaaaatcaatgttattgcaagtaacaatgatgagatggcgattggtgcagtacttgcaagccgcaagttaggtattaaagatgaagacatcattattgtaggtgttgatgcaacaccagatgctcttgaatacttaggcagtggcttagacgcaacagtattccaatcagctcaaggacaaggatacgctggagcagaaatcgcttataaaatcgcaaaaggagaagctgttgaaaaatacaactgggttccatttgaattagttactccagatctcaaagataaatatagagcaaaatataagtaatggattattcactgattaaagagggtttcctctttaatcagtttactattttattcttagtcaataaaagctaaaaacataatcattccttaaaaaaatcaaggagttaacaatgaatacacatagctccccttatattttagaaatgcgaaatgtctctaaaacattcccaggggtaaaagcattagatggcattaatttaaaagtcaaacgtggaaccattcatgctttaatgggagaaaatggagctggaaaatccactttgatgaaagtgctatatggactttatattccagacgagggaagtgaacttatctttgatgataaaccgtttaaacctagccgccctattgatgctattcgtagtgggctcacaatggtacctcaagaaatatcacctgttgccaacctgactattgcagataatttctatcttggacgagaaatgactaaaggaaaattcttcttagatcaggcagaaatggatcgcaaaactgcccaaattcttgaagaacttggtattccaatggatgttaccgtaaaaatgtcggaggtatctgttgccaaagcacaattagttgcaattgcaactgcagtatctaacgatgcaaaactcattatcatggatgaaccaacaactgcattaactgaaatggaagttgagcagctatataaaatcattgacacagtaaaaaaacggggaattgcgattatctttatctctcacaagcttgatgaagtattcaaagtatctgatgaaatcactgttatccgtgatgggcaatatgtaggtacaaaacctatcgatcaagttaccaaagaaaaacttatttcaatgatggttggacgtgatatgtcagagatgttccaaagagaacgttttgaattatctaatgaaattgttcttgaagttaagaattttacgcgagcaggaaaatatcaagatgtcagtttttctgtgcgtaagggagaaatttttggaattgctggcttagtgggagctggtcgctctgaaattgttgaaagtttatttggttataaacctgcagatagtggagaaatttatattcacgggaaaaaagttgagataaacaacccgcttgatgcaatggaacataaaatcggctttgtgactgaagaccgaaaactaacaggtttattcctgaacctaaatattatcgacaatatgattatgcctcaaatgtcaccttatttagagcattttctcatttctgttgataaatcccataaaactgccaatgagcagaaaaagaaactcaaaattaaggcacctgatgtagaggttattacaaataacttatctggaggcaatcaacaaaaagtgctacttgctcgttggttattacttgaaccagagattttaattttagatgagccaacaaaagggattgatgttggagctaaagcagaactttataagttaatggtagaactctcaaaacaaggtaaaaccatcattatgattacttcggatatgctagaactattatcgatgagcgatcgcgtaatggttatgcacgaaggtcataaggttggcattattccacatcaagaactctctcaggaacgagtcctagcatttgcatctggattagtaaaacagtaaagactcaaaccatattatttataaatagcgaggtatgtactatgtcacaagcaacattaaagaaaataattaatacatatggaatggtgttaattttaattattttatttctcctattatccgtttctatcgaaggctttttctctgcccgtaccgtgtggagtattattgagcaagtatcaatgttcggtattattgctattggggtaacgtttgccattatcaccacagggatcgacttatcctctggatctgttgtcgcactaacctccgtagttgcagcctcaatggtaacagggggagatttagctagttctgccattttagcctttgcaatgtcccttgctctaggtgcttttttaggtgcaataaatggtgggttaactgctctcggtggtattccgcctttcattgcaaccttaggtatgatgattattgcacgtggtgctgcacagctttattctgctggacgccctatcgatgcttcatctgaagcctttacttggattgccgatgtaaacattctgagcttacctggattagttattctctatattctcattgttattggctcacatattttactaagccgttcaacctttggtcgtcacgtttatgctgtgggtggtaatctcaacgcagcaaaaatctgtggaatcaatacaacaaaaacattaattcttgtttatacctttgcgggggctttatctggtcttgctggtgcattacttgcagctcgtacctatgcaggtaacccatcttatggcttagcgtgggaacttgatgctatcgctgcggcagtaattggtggtgtttcgttaagcggtggctttggaaccattccaatgtgtgttatcggagctttaattatcggtacaaccaataaaggattaaatatgttaggcgttgacccttattggcaacaaattgtgaaaggtggaattatcgtgattgccgtattgctcgatacattaaaacgccgcagaaaagccgcatagtcgcataaatatatagattacaagcggcaagatatctctaaaagtttgcaacattttctgtatatcataccgcttacaacttaaggagctttgtatgaaaaaagtgagaattggtttagtaggtacgggctatatcggtcgttgtcacgcaattgcttatgcacaagcaccaacactattcccattaaaaggtgaactacaccttgagtttcttgccgaaattaatcaagaacttgcagagaaaaaagcgaaagaatttggctttgctcgagcaacaggagattggagagaactggttgcagatccgaatgttgatgttgtagatatttgtaccccaaatttcttacataaagaaatcgctttggttgccattgctaatggcaaacatgtttattcagaaaaaccgctcgcattaactgcagcagatgcaaaagagatggttgaagcagctaaaaaagcgggcgtaaaaacgctcgttggtttcaattatatgaaaaacccaacatcacagcttgctcgtgaaattatcaaaaatggcgaaattggtgatgtggtgcatttttatggcacacataatgaagactatcttgctagcccaaatacaccgattgactggcactgctatcgaagtaaagcaggattaggtacgttaggcgatctcgcagctcacattgttaatatggctcattatttagtcggtgaagaaattacctcggttgtgggcgatatgcaaaccgttatcacagaacgcccaaatccaaataacctttcagaaaaagtgaaagtagaaaacgaagaccaagcaaccgctatggtgcgttttgccaatggtgtgatgggaacgattgaaagctctcgtatcgcttgcggtcgtaaaatgggcttgacctacgtggtaacaggaacaaaaggcacattgacctacacccaagagagaatggctgaacttaaactttatttacatgatgaagataaatctcgtcaaggatttaaaactattctcgttggaccagaacatcctgactacgccgcattctgcgtaagtgcaggacacggtattggttttaatgatcaaaaaagcgtagaaatccgtgatttagtcaatggtatcgccgcagatgacagaatgtggccagattttgaagaaggatatagagtatccagagttctcgaagccatcgctaaatccgctgaagaaaaacgctgggtagatgtgaaagaaatttaatatgaaatcggaagggtctgcatatcacaatatatgcggaccttatttttatgtatgctaaaaataggagcctactatgactgacactaaacaaaaacgttaccacgcagactggcagtcaatcaaaacccatgaggtacctcaatggtatgaagatgctaaatttggtatttttatccactggggagtttattctgttcctgcattcgctccaccaacttgccaattaggtgaaattgatattgatgagcagtggttctgtaataatccgtacgcagaatggtattttaattccattaacgttcagaaaggaccaacttacgaacatcacattaaaacctatggcaaagatttcacttacgaccaatttattccgcaatggaaagcagaaaaatggcaacctgaaaaatgggcagaactctttgctcaagctggggctaaatacgtcgtgttaacgacaaaacaccacgatggcttctgtttatatccaagtaaatataccgatttcaactgcaccaaagcaggtcctcaacgtgatttaatgggtgaactcactgaacaagttcgagaaaaaggattacgtatgggagcatactactctggtattatcgactggcaatattcttcagcacctatttttacagaaagccaaaatttctctaatgcctgcccaacctacgaatatgccgactttgcttataaacaagtcattgaattgattgaccgctataaaccagatgttctatggaacgatattggttggccaaaagtaggggaacatatgcttccacacctttttgctcactactacaattctgttgcagatggcgttgttgatgatcgttggaataaactttggtgcgactttacgtctaaagagtataaacacggaacagcctctcgtgataaaaaatgggaaatgtgtcgcggcatgggactttctttcggctacaaccaaattgaagatgaaagtcacctgatttctgttaaagatctcgtgtctcttttagtagaaactgtcgctgataacggtaacttattgctcaatattggtccaaaagcggatggaacaattcctgaagaacaagtggagcgtttgcttgctctgggacaatggctaaatatcaacggtgaaggtatctaccattcaagatgtagtaaattccgaacacaaaaaatcggcaatctcaccacctattacaccaaagtaggatctgatctctatctctttattgatggattacaaaacggacaaaataacttaccgctttcagtgtttggtgagcttgaatcactaaataaagctgttaagtttaacgttgagcacaacgaaaaaggcagaacattacatatcgaaaactatcaagaagattggtatgtgttaggtttcaaaattgcaaatggagaagcatagtatgtcaaccacatcaggacgttttattgattttatgaacaaccacgttgcaccagttgcaaaacggatggaaaatcaaccacatatttctgcaattcgtgatggttttattgttgtattaccatttttgattgtcggtagttttatcatgattttgcttattccaccttttgatgagaatacgcaaaatgcatttggtaaagcgtggtgggagtttgctcgttgggcaagcgactatggctggcgtttcttccaaatgtcatttaatgccatttcattatttaccgcaggaagtattgcatacaacttggctaaagcttataaacgtgagccactgcctgcagcgttcttatctgtgatggctttcttattggtcgctgcaccagttaaagacggtatgatggacattaaattttttggtggtattggactgttctcctctatcttcattgcaatttataccgtagagttaacacgcttacttgagtatttgcatattcgcatccgcttaccaaaagaagttccaacagcagttgccgaatctctcaatattgttatcccaattctagctgtattagtgacactctacccatttgccctttatgtagaacacgccacaggaacaaatattccacaattaattatggactttatggctccattaattaaagtgagtgactctcttggtgcaatctgtttattcgtatttgcaacgcacttattatggttcctaggtattaacggatcacttgtattaatgcaactttggacaccattcctattacaaaatatggcggcaaacttagcggcattacaggcaggagaaccacttccattcattattactaactcattttgggacttctacattgtacatggtgcatctggtggtgttattgcattagcaatcctactcgtacgcagccgctctgcacatttacgctcaattggtaaaatcggtttggttccgtctatcttctcaattggtgaaccgattgtgtatggtgttccaatggtggttaacccactattctttatcccattaatctttgcaccaatggcaaatgcgatcatcgcttatctcatcttagactttgatctcatccaccgcatctacttaatggcaccttggacaacccctgcacctatcggagcttatttggtatcaggtggtgatgtttgggctcctatcttaagcttgagtttaatcatactcgatattttcatttactatccattcttcaaaatgtatgaaaaaatctgtatagcgaaagaacaaaaccaagatgctgagtcattagaacaagaacgattaatggcagaaagagcaggagctgaagctaaataatccaagctataaataacaagacctagccaagtggctaggttttttttatgtctcaaatactgatttgatactctaaatttaccttaatcaataaaaatgaaagcggtacgattttgcaaaaaatttaccaaatcgtaccgcttgtatcgggagaattaagcgacttcgcttaatttaactggacgattttcttcaagagattttttcgctgccaacgcaattaagacaggttgtaaaccatcgttaccgttgacgagtgttggtttattgtttaccacagaatcaatgaaacatgccatttcatctgcgaaagattgcatatagcgctctaagaagaagtattttggtttttctgcaataacgccagcttcacaagaatatacagcagttgaatccgtatcgttacgagtttgtaccgcacctttagaaccaaaaacttctgcacgttggtcgtaaccatataccgctttacggctgttatcaatgactgcaattgcaccatttgctagttttaaggtgatcactgcagtatcaatatcaccagctttaccaatttctggattaactaatacaccgccagccgcaaacacttcaaccacttcactacctgataagtaacgcaccatatcaaaatcgtgaatagtcatatcaaagaacattccacctgatacttttacatattcaattggtggtgcatctgggtcacgagaagtgactcgaatgaggtgtggttcaccaatatcaccgttcacaacacggtttttaattgctttgaagttatggtcaaaacgacggttaaaacctacttggaattttacacctgctttttcaacagcacttaatacttcgtgaatacgtcccacatctgcatcaattggtttttcacagaaaatatgtttacctgcttgtgcagcttcgattgaaattggtgcgtgagtattggttgatgaacaaaccaatacagcatcaatttcaggatcttgtaggatttttttgtaatcatcatagacattcggaatgcccattgattttgcccaagcggttaattcgtcagtgaccttaatatctgaaatcgctttaatttcagcaccttttacatattttgagatactttctgaatgtacacgaccgatacgacctgcaccaataataccaacttttaacatattaaactcctgcgacttcacgaatatatttgcgaccttttaaagcatactcaaatgggttagctaatgctggatcctgttctgcttctacaaccatccaacctttgtagtcgtatttttcaaggatatcgaaaattggtttgaaatcgattacaccatcacccggaacggtaaatgtaccttttttcacaccttctaagaaacttaaatctttggctttgacttctgcaacaacttcatcacgtacgtcttttaagtgaacgtgtacgatacggtgaatatatttttcaagtacagctaacatcgctttttggcagccttctgaatagtaaaggtgaccagaatcaaataataagtaaacatcatcattgacgacagacatatagcgatcgacttcctctggagtttgaatgcctgttcccatatggtgatgtaggctgactttcattcctttttcagcagcgagtttggctaattcattataaccctcagctaaacgttgccagtcttcatcattgaaaatgggtttttctttaaatactgcttttgttgtaccttgaatactacggctttgctctgaacaaccaattacttttgcccccattgcgtgtagaaaatcacggtgtttgataaattcttgaatggtttcttctcgtttgccatcaacaaagaatgtgctgaaccatgcattacaaatttgaataccacggacatctaatttatgtttaaggacagcaacatcacgtggatatttgttacctacttcgcagcctgtgtagcctgcaagtgccatttcactcacacattgttcaaatgtgttttccgcaccaagttccggtaaatcatcgtttgtccaaccaataggggcaatacctaattgaatgttttcagctttcatagtgaaatcctcattgagaaataaatagaaagagtgtaagcggtatgatttgcaaaaaattttacaaatcgtaccgcttgtaattaatattttcttgcttttgctaactgttctttagaacgttgatgtgcttgctgaatacgttcactcgttgaaacatcagcaacaccaacgtgccaccaacaaccatagccatgagccattgtttttggtaatactttaatatcaattaacgtagatacggtttgttgttttgcatcagctaaggctttgcgtaattcatcttcggtagtaactttgtaggttttgcacccataagctgcagcacacattgcaaagtcaactggaattaagccaccattaagttggtttgtttcaggattgcggaagcggaactccgtaccatagctacccataccgttaccaacttgtaagttattaatacaaccatttgccatattatcaaacaacacgacattgatttttttgccttcctgaattgaagtaacgagttctgagtgggacattaaaaacgcaccatcgccaactaacacatatacttcacgctctggttgtgcaattttcacaccaacagctgcattgacttcatatcccatacaagaatagccgtattcaagatgatagctgtcttcactcttacttaaccaagtacgttgtaaatcacctggcaaactacctgctgcacctacgataactgcactattatcaatcgtttcatttacaatacctaaaacttggctttgggttaggcaagagttggtgagtttgataaattcagcataaacggcatcatgatcaagattatcattaatttctggtacaaatccgtcagtaaattttacctgacgtaagcgttgtaattcgtcagcaaagtctgctttggcttgtttaatagcatctccccattgcgttttataacctggtggtagcttatcaatcactgcattaatggattgtttcgcatctgcggtcacctgaacaccatctaatttatacgcatcaaaacgagcaatattaatatttaagaaagcgacatctggattttggaaaatccattttgatgatgttgtgaaatcggtataacgtgtaccaatcccgataattaaatcagcttctttagctaaacggttagcagctaaacagccagtttcaccaacaccaccaacatttaactcgtggcttgaaacaattgcacttttacctgcttgtgtttctgcaaatggaataccaaatttttctgccaaatgttgtaatgaacgacacgcttgagaataacgaacaccgccaccacaaacgataagcggttttttcttagaggtgattaatttgacagcatcagccagcatctcttgggttggtggtgtacgttcaatgcgatgtactcgtttttgtaagaagcttactgggaagtcataagcttctgcttggacatcttgtggtaatgcgatagttacagcgcctgtttcagcaggatcagttaacactcgcattgcattgatacaagcactcattaactgctcaggtcgttgcactctatcccaatacttgctcactgaacgaaaagcatcgttagtgctaatacttaaatcatgcggttgttcaatttgttgtaacacgggatcaggttggcgagttgcaaatacatctcctggtagtaataatagaggaattcggttagatgtggcagtagccgcagctgtgaccatattggcagcaccagggccgacagaggatgtacaagcaatgatttgttgacgtttatgttgtttggcaaaaccaattgcaaggtgtgccataccttgttcatttcgtccttgatataatctaagactgcctggttcttgctctaaagcttgtccgataccaagtacattgccatgtccaaaaatagcggcaataccgtgaacaaatttaatttctttgccatcaatttcaatatattgattatcaaggaatttcacaagtgcctgtgccactgtgagtttgatagtctgcatactccctcctaggttagagataaaattaaagtagtttctcatattatgaaaaatttatttcattttataatatcaaagcattttagttaatgatgtgatctatctcgcactttttaaactttattccttattggttaaagatttgacattggtcacaaaaataaataaaaaatcaagtttaatttgaaatattcatttcattttgtataatgattgaaaattaagatcttttcaattattttatggaggcattgttatggcatacgttaatcatcaagatcgccctcttgatgtcatctgtcttgggcgagttgcggtagatttatacggtcaacaaattggttctcggcttgaagaggaaatgagtttcgcaaaatatttgggtggctcatcagggaatgtagcgtatggaacagctattcaaggactacgttcatctatgttagcgcgtgttggcgatgagcatatggggcgttttcttcgtgaagaattaaatagtataggcgtagatactagccatttaattaccgataaagagcgtttaacaggattagtgattctcggtattaaagataaagaaaccttccctttaattttctatcgtgaaaattgtgccgatatggcgatcagtaaggatgatttcagtgaaagctacattgcttcgtcacgtattttagcaattacaggtactcatctttctcaccctaaaacacgagaaacagttttaacagccttagaatatgcaggtcgtaatgacgtaaaacgtgcattagatattgattaccgtccagtattatggggattaacctctttaggtgatggcgaaactcgctatattgattcacaggaagtgactaaatctcttcaagaagtacttcatcactttgacttaattgtaggaacagaggaagaattccatattgctggtggatcaactgataccttaaccgcattgaaaaatgtacgtcaatttacacaagccgtgttagtttgcaaacgtggtgcgttaggttgttctgtatttgaaggtgatattccaaatcatattgatggcggattaaatgtgtatggtgtacgggtagaagtattgaatgttcttggtgctggtgatgcctttatgtcaggtttactaagaggttatgcaaataacgaaggatgggaacaagcctgtcgttatgcgaatgcttgtggtgctttagttgtttctcgccacggctgtgcacctgcaatgcccacaaaacgagaattagatgattatctcagccttgctgaatctgttcctcgccctgatttagatgaaaaattaaatcacttacatcgtgttactacacgcaaaaaacagtgggatgatttatgcatttttgcttttgaccatcgtaaacaattagtggatatggcggctaaagtaggtgctgatgttaatcgtattccaaaattaaaacagttattgcttaaagctatggagcaaaccgcacaagcggaaggtttaacccatggaaatgcaggtatcttagctgatactacatttggtcaagatgcgttaaatgaaattacggggaaaaattattggatagctcgtccaattgaagaaccaagttctcgtccattagagcttgagcacggtgatttaggtagccaattagttacattcccacgagatcatgtgattaaatgtttagcattttaccacccacaagacaatcaagagcttcgtcagcgccaagatcgtaaattaaaagaagtgtatcaagcctgttgccgtactgggcatgaattgttgttagaaattattctaccagcaaccatggatcaagatgaaaatcactataatgaaatggtagaacacttctatcaattggggattaaaccagaatggtggaaattaccaggtatttctgcagaaggctgggctaaattgagtgaaacaatagataaatacgatccagattgccgtggtatcttaattctaggtctggatgcaccaacagaagtatttgaagcggtcttcaaagcgtctaaagattgctcaaaagtgaaaggatttgccgtaggtcgcaccatttttggtgaagcatcagaaaaatggttagcaaatcagctgaatgatcaagagttaattgatgcagttgcgttacgttatcaaactctgattcgttattggaagcaacgctaattttgcatactaaataaacataaaacacccctaatatgataaatattaggggtgttttgatttaaaaagcaacaaaatacagtataattgtgcttaatttgataataataatctgaatgaaatgaatgaagaaacccagttaacccattttcaaaatgaagttcgtaaacaatatgactcgttaagcaaaagactcaaacaagttgcacaatatattttagacaatggagatagtgtaatttttgacaccgtttctgaaattgctgaaaaagcacaagtaccgccttcgaccctaatccgttttgcgaatgcttttggcttaagtggatttaacgatataaaacaactctatcgacaaaatttgatggaaggaacaacaagttatactgagcgagttcaactttttcgtcaaatagaacctaaattaaatgaatccaaaggcgatcatacagatgtccttcgcttatttattcaaggaaataatcaagctctcgctcaactagccaatcaaattaccgaagaacaattagaagccgttacaaaaattctagataatgcaaaccgtatttttattgttggcttaaaacgttctttcagtatcgctagttaccttaattatgctcttagccatctcaattacgatgtctttttaatagatggattaggcggtatgtttagtgaacaactaaataggattagagaaggtgatgtcgttattgcaatcagtttttcaccctatgcgacagaaacaatatctgtactagacgcaactgctcgcacaggtgtaaaacacatagctataacagatagccaacttagcccactgcttacattcagtgatgtttcttttattattaaagaagctcaaattagcggcttccgttcacaatgtgccacaatgacattagctcaaactatagctgtttcattagccttaagaaaagcttcatagtaaaagggcgagtaatttaactactcgcccttctaacataacatcaaattaatgtttctcttcaactctcaatccataagttgagaatttgcctaaaacgactttaatttcttcatcagaaagaactggtacatctggtgtcgttgccaatagtttcagataccattgggctaacacttcaacttcgtgagccacccaaagggctttttccagattgacttcagcagcaatcattccgtgatgttgtaataaaatcgctttgctttttgcgataccttgttttacatattccgcaagttgccaagtaccgaaagtagcataaggtacacacggaacgtgatttgttcccgtaacgccaatcatataatgaatagctggaatatctttatttaagatagatacacctgtgcagttgatagcgtggttatgcaccactgcatttaactctggacgagtttggtacacggcaaggtgaaattgccattcacttgacggcagttttcctgcttcaaaattgccttcgttatccacatagacaatatcgtcttctgtcattttttcataaggcatacctgatggggtgatcagcataccgtcttgataacggacactgatgtttcctgccgtgccttggtttaaacccaaacgggtcatttccaaacaggtgtcaataatttttctcgctaatgtttgacgattcatactctcctcctaatctgttaaaactggggtaacgccttttttcaagatgatgttaccgtatttggctaattcgcctgtaatcactacggcataagcgatttttgctcggtcgtaaaaggcgaagcgttctacacgttcaacaagcggtgctcttccgttaatttttgcgattgcggcgagatagcgttcttcaaccgcaagatcaaggctgtcgccatgtaccgcttgcatcattgccagtggacgttcgacatattggtcatattcaaataatggggtgatcgcttcaagtaaggtggcaatttgaataccatctgcacggatcactttatgatgtaattgatgtgcaggaaaatgggcatctgataagacgatctcatcgccgtgtcccatctctgcaagcactttcagcaattcaggggaaagtgcagggtgaatgccttttaacatatattctccttgttttttctctacctcattccccctctttagcaaagaggggttaggggagatttggcagacgaataagcaaagtgagagattaaaaagtccttaatattttactactcgttaccaaataaattattttcttcgttaattactcctgtcaaatctcccccagcccctctttgctaaagaggggagctatattggggaaaatttacgctcctatgattgataaaccctcacatctccactcggctcaactcgtttaaacgctggtttcattgcctgttgagcttgttcgatattctcgaatacgcctgcacctgtgagcgtgaacatcgctgcacctaacacagtggtttcggacatatcaacgacatcaattgggcagttaagtacatcggcacggatttggttccataagccgttttttgaaccaccaccaacacagataatactttctgcattgaactgtccgacttgttgcaatacctcaagtccggctttcaagcggtgagccatatattccaaacctgcacgataaatttcgccccgttgggtgtgcattgatagcccttcgattgagcctgtttgttggctggtaccgtcaaaattgccgaccagttttacgccgttcgaacctgctggaacttgtgatccttcgttaatcatcgttggataatagtcagctgtgcctgcaacatcgctaaagaagcgtttaccgagccactccataatacctgagctgacccattgcacgcctgggttgaaatagcctgcttggctgtcaaattcaatggttaagccatctttgacgtattgccattcgggtttggcttgttgggtgcgagccattaagatttcccaagtaccagaacttaacactggttggttgtagcctgctcctgagccgaagatcgcaaactgggtatcgtgtccgcaagagagaactggaatatctgccgataaacccagctcttcagcaagtgtaggcagtaatgtaccgattttttcccctgcacttttcatcggtggaaaatggtttgccgttaagcccaacacatctaacacttggctatcccacgagtcgcttgcaatgttggtcatcattgatgtaccagccattgttctgtcggtgctttgtacacccgttaaacgataagtgagaatggaagaaataaacaagaaactctccgcttgtgcgtaaagttcgggtttatgttgtttcaaccaaagcaatttgaataacgtgttgaagctgtaatgccccacgccgttgcgttggtagagtttttccacattgagataatcgccgagcgcttgcataattggctgagtgcgtgggcatttccacgaaataatcgggtagagctgtttgcagtgtttgtcaaaaatcgccccgtccaccccaaaggtcgtaaccgaaatcccgacaatatcttgccgttgttcaggggtaagttgtgcaagggttggtttggcacaggtcattagttttgaccagatctcatcaatatcccaaatgtgatagtcggttgcttcttcaccctgttgggtattgtttgcaatgtgatgtaccgccagcaatttgccgtgatgatccattgccactgtgcgtaaattggttgcaccacaatcgaagataaatgcgattggcatagaattatctccttaaaaaagatataccactctctcccgtttacgggagagggaatagagatcttaacgataaagcggtccaaagttcgcacaagcacggtaatcttgaccttctttatcttgtccgaacatactccacgcacttgggcggaacacatctttatctgccacgttgtgcatattgactggaatacgcaacattgaagcaagggtaattaagtccgcaccaacgtgtccgtaagtggctacacagtggttcgctccccagtttgccattacagagtaaacatcggtaaacgcaccttgtcctgtcaagcgtggtacaaaccaagtggttggccaagtttcatttgtccgtttgttgagaatgtcgtggacgtgttcaggtaagtcgatagaccaaccttccgcaatttgtagtacagggccgacacctttcactagattgatgcggtgcatcgtaaatggcataccacctttggtgagatattgtgaagataaaccgccgccacggaagtattcataaacagctggacaccaacgggtattttctaagcaacgtttaccatcttcttctgtcacttcccagtacggtttaatcacaggtttgccatctttatcggtatgttgtcctgtaccgtctaatgcggctgaacctgagttgattaagtggataaagccactctctggtcgccagcttgttacacgctctacggagtcttggctccagtaagtacgcacatcggcaaagatttgagcttgaccggttaagaggttaccgaacaacatattaactgcattgagcgagtcgttttcggtcgcaagaatatatggaggacgcacgccgttccagtcataagtagagttgagtaaggcttccataaagtcgccgttcgggctgtggtctgtccaatggcgttgtccttggaaaccagcggcaatcgcattatgacctaaggcttcttcaccaaaattgagttcagccagttttggattgcccaccattaaatcacgggtgataatggtcattttcaccaaggtttcacgcaatttagctttctcttccgcactcatttggttttcaggcgcattgacatccacaccttcaatgcagaattcatttgcccatttcaatgccaactcatactcttctttgtcgtaaataccacgttccatacggcgagtgagttcagacatatcaacatattcgttacgcatacccaagtagtcttggaagaactcttgattaacgatagagcctgcaatacccatcgatacagaaccgatagagagataagatttaccgcgtaaggtcgccaccgctaagcctgcacgagcaaagcgaagtaatttttcacgcacatcatcagggatagattgatcgctcgcttcttgcacttcggtgccgtaaatagagaacgccggcaagcccatttggttatgccctgcaagtgaagccgctaaataaactgcccctggacgttcagttccgttaaagccccaaatcgcttttggcatatgcggatccatatcaatggtttcagaaccatagcaccaacaaggtgtcacggtaatcaccgcaccaacattttcacgtttaaatttttcggcacaagcagctgcttcaaatacaccaccgatacaagtatcggcaatcacacattcgacaaaatccccatttgtatggcgaacttcttggctaatgagcttcgccaccgctttcgccatattcattgtttgatcttccaatgattcacgcaccccaagacgacgaccatcaatggttgggcggataccaatttttactggagttgatttgagttgagtcataaaaatccccttaattaactggttaaactgacgaggatattttgctacttattgacgatgaaaaaagaatttttacgaaatttgtgcagattttgtgaattgcctcacaaaaagccagccctaagcggtaagattgagtaatttttttacaatttacttgcccgatttggcgatagaaaggggaaaatcgggcatcttttcaacataaaataaatataataatatgcgtactaatttcgttttaaaccgaaattggtatcaaatattgataaatctatttgataggttttattttcatcttaacaggagttttttatgagtaatttgaaagtaggagctttatgccttactgtattaacattagtcggatgtgctactgaaaattcaaaagtaattacaccaacatcaactcaggcagcgacaactgcaagtcaatataaaggcgtaaaatcagttatttcagtaggaaaatttgataacaaatcaagtttccaaaacggagttttctctgatggtcctgatcaattaggtaaccaatcaaaaacaattttaatctctcatttgcaacaaactggtcgtttttctgtggttgatcgtacaaatatgagtgaaattgcttctgaagcaaaaatcaaaggtaaaaaacaaaatctaaaaggtgcaacttatgtgattactggcgatgttacagaatttggacgtaaaaccgtaggcgatcatcaactatttggaattctaggtagaggaaaagaacaagtagcctatgcaaaagtgaccttaaacgtcgttaacgtagaaacatcggaagttgtttactcctcacaaggtgctggtgaatataatttatcaaaccgtgaagtgctaggttttggtggaactgcaagctatgatgcaacactaaatggaaaagttcttgatcttgcaattcgtgaagctgtaaataaccttgtaaatggtatcgaatctggctcttggcagccatctcactaaggaatcaatatgaaaaaaataaaatatactattttccttgttagctctatcattttatctgcttgttcttctaataatgtaaataaagatatttactattggggaaattattctgatgttatatatcattattataatgaacctggtgattttggtaagcaagaagaaagtttaaatcaaattattgctgaagcagctaaacatcaaaaaactgttgcacccggtgtatatgggcatttagctcttgttttattaaaacagggaaaacaagctgaagctcaaacagctatgaaaaaagagcaggaattacatcctgaaactacaacgcttatgcaatacctacaacgtaaaaaatagggatcatctatgaaaaaattgtttgttttattaacaagtttaatattattagctggctgtgctaaacaaaaagtggattcttatgattatactgagttaaaaaatagcaaaccaaaatcaattttggtagtgatgccaacaaatagctctgtagatgcaaaggcggatataagtgttcttgctagagcaagctatcctttaggtgagctaggttactatgtttttcctgttgcattagttgatgaaatattcaaacagaatggtttaactgatgggaatgcaatccgctcagcaaaaacaaacaaaatccgtgaaatttttggtgcagatgcgatcttctatgtgaatgttgaggaatatggcacgagctataaattaattgatagcgtaactaaagtatccttagaaggaaaactagttgatctcaagacaggaaaaaccttatgggaagggattggttctttcgcacaaggatcatcaaatagtaatgatggtctgctagtgatgctagttaaagcagctgtgagtcaaataatggataccagtaaagataaagggtatcaaatagcagcacctgcaacatcaaatcttgttcacttagggaaaaacggtggtttgcttattggaccaaaacatcctgattacaacaagactcaagtaagtaaatagcagacttaaaacaaaattgccttgtttctaaacccagatttatgattagcggaataaagaagcagggcaaaatttgagcattacattattattttactttaaatagttatattaatttgatgttgcctacaaagcatctgaatagaatcaggaggggaacgattcgtaaataaatggtgaattgtagaaagatcacaaagttgtatcagatctttacgttcaaattttgaatgatccgccaataaaaatactttcttactcgctgctagcatttttcgtttagctattgcattcatttcattagattcccacacaataccgtctgcaataccggtgcaagaaaaaatggcaatatctatatttaaacgagatagtatatgtcccgaaagagagccataaaatgcatcatatttcgctgaatacacaccacctgttgcaatgatctcaatgctggttttatttgccaatgctctaatattgtgcatagaacttgtaacaactgtacaaggtagatcaggtaagagttgtgcaaaattccagctacttgaactcgcatctaaacctatcacagctccaacaaaaaaatgctctaatgcattttctgcaatagactttttcacgttactattcattctgcgacgaacatcaaaagaacgacctatatcacgatttttatggcttaccgcaccgccgtgagttctatacaatagaccttcctttgccattttattcagatcacggcgaatagtttccaaagaaacgttgagatgtgttgcaagctcctgcacgctcgcttcttgataggtttcaatgtaagttaaaattaattgctgacgatgttgcataaagtttatccataaacaactgaactgcacaaattttagggatttttttctaaaagagaagctaatccattaaaaactgtgagttgtgtcacattataaatagaatagatattgttcaaaaaaagggaaaagtaattcatttcatctgtggataactctcttttttcctgtatttatcttgagatctattcttgaataacttatcaaaaaatatcatctgtggataacttaccactttatccacaactaagatcttactctttttcaagatcatcacaatcgtattatctttagatcttattgaatttattacatatttattagttattcacagttcttcgtaagactaataactacaataataaagatctttatataaatagatctttttttattaagatcggcgatcattatcaagaccctattcaccttagatcaaaaccttttttcagatcttgcttttttcaggtagaatagacaaattttcatttaaacagaatttaatcaaggcaaataagatgatttatcgtgaaatatacgatgtgatcgtagttggtggaggacacgctggtactgaagcagcactagcccctgcgcgtatgggtttaaaaaccttacttttaacacacaatgtagataccttaggacaaatgtcttgtaacccagcgattggtgggatcggcaaaggacatttagtcaaagaaattgatgcgatgggcggtttaatggcaacggcaacggataaagccgggatccaattccgcaccttaaacagttcaaaaggcccagcagttcgagcaactcgcgcgcaagcagaccgtgtactttaccgccaagcggtgcgtactgcattagaaaatcaaccgaatttggatattttccaacaagaagtagtcgatattctagttgagaataaccgtgcagtcggtgcggtaaccaaaatgggcttaacttttaaagcgaaagcggtcattttaacggcaggtactttcttggcgggtaagatccatatcggtttagataactacgcaggtggacgtgcaggcgatcctgcagcagcaatgttggctgatcgtttgcgtgatctcaatttgcgtgtagatcgtttaaaaacaggcacaccgccacgtttagatgctcgcacgatcaattttgatgtattggcaaaacagcacggggacgaggttttacctgtaatgtcatttatgggatccgttgagcaacaccctcgccaaattccgtgttacatcacacacactaacgaacaaactcacgatttgatccgtaatagtttagatcgtagcccgatgtacacggggattattgaagggatcggacctcgttattgcccatcgatcgaagataagataatgcgttttagcgatcgcaacagccatcagatctacctcgaaccagaaggtttaaccaccattgaggtttacccgaacgggatttcaaccagtttgccgtttgatgtgcaaatggggatcgtcaattcaatgaaaggcttggaaaacacccgtatcatcaaaccgggttatgccattgagtacgactatttcgacccacgagatctaaaaccaacccttgaaaccaaagcgattgacggcttattctttgccggacaaattaacggcacaaccggctatgaagaagcagccgcacaaggtttattggctgggatcaacgctggcttacaagtacaaggcaaagatgcgtggttcccgacccgtgatttagcttatacaggcgtattggtggatgatctctgtactttaggtaccaaagagccgtatcgtgtctttacttctcgtgcggaataccgcttgttgttgcgtgaagacaatgctgatgcgcgtttaacaccgattgcccatcaatttggtttaattgatgaagcgcgttgggctcgttttaacgagaagatggaaaacatcgaaaaagagaaagcgcgcttgaaacagacgtgggcgcacttacaaatgacgaaccttgcggaagtgaatgcgttattaaatagcccacttgcccgtgaagcaagcggtgaagatttaattcgccgtcctgaagtgacttacgaagccttaactcaaattgccccttttgcaccagcgattgaagataaagaagcggccgagcaagtcgaaatttcgattaaatatcaaggctatatcgaacatcaacaacaagagatcgaacgccacaaacgccacgaaaacacccaaattccagctgaatttgattacgacaaagtggaaagcttatctaacgaagtgcgtgcgaagctgatgcaacatcgtccagtctctatcggacaagccagccgtatttcaggcattactccagcggcgatttccattttattggtgaatttgaaaaagcaaggtatgttgaaaagaggcgagttgtaaaatttgccaatcatttcaataaattaatcgtagggacacactgcgtgtgtccacaaggggttaataaaatctaaaatgtgtaaaacattgatagcggacacacgcagtgtgtccctacatattgaattaaatgtttcgtggacattatacaattcaaccttgttgtaggggctaatcacattagcccctaataaataccgaataaatttaattaggcaaatatcatttgccccacaggaaattgaatgaaagacaaagcattgccggaagggtggaataaaataaatataactaaagtatttacccaaatatcaacaacaggtaaaaatatctcaaccaaagattgtttatctgttggtaaataccctgttattgatcaaggtgctgaatatatttcaggctattttaacgatgaaactaaagttattcctgttgaaaataaggtaattgtttttggtgatcatacaagaaatttcaaattaattgattttgattttattgttggtgctgatggtgtaaaaatttttcaacctgcaaaaaatatagatcctgattttttttattatcagtgtttgtcattaaatttgcctaataaaggttatcatcgccattttcgttatttgaaagagtgtgattttatttacccttctttttcccaacaacaaaaactcgccaaaaaattcaccgtacttttatctcaagtggcagaaatcaaacaacggcttgagaaaatccctgctttactgaaaacttaccgccaatctgtgctggcaagagctgttaatggagaattatcggcgaaatggcgggaagaaaatggggtaagtttggagagttgggtatatgaaaaagcacaacatatttgtgataaagttcaaagcggttcaacccccaaaggtaatccatttgagcaaaatggcacaattccttttttgaaagtttataatatagtaaatcaagaattaaattttgattacaaacctcaatttgtaactaaagaacaacactcacagcgttcaataacattacctaatgatgttttgatgaatattgttggtccgccacttggaaaggttgcgattgttacaaatcaatattctgaatggaatattaaccaagctattacgctttttagatgtaatcctagaaatttacattataaatttttttactttgtccttcgagaaggtagatttattagagaaatagaacacgatttaaaaggaattgttgggcaaattaatatatctttaagtcaatgtagagatatgattgttcctgtaccaactcttgaagaacaaaactacatcacccaagcggtcgaaaaacacctaaactttgccaatcagcttgaagcccaagtcaatgcagctttggaacgggtaaatttaatgacacaagctattttggcgaaaggatttcgtggggagttgttataattgccaaaattttgccaataattttaaataaaaaccgaggagcgaataatggaaaccaacttctcttttcttcaagcctttccaaccttattcaaacaggttcaatttgcagagcgttatttttctgaagatccgaatacgtcaatgtataaactccgccagtttggcgagttcttagccaagcaaattgccgtacgttttcgtttggcactgcctgaaaatatcacgcaaaatgatcgtttaaaagcattgaaagaatgtcgccttgatcgtgagattttgtcaatgtttcattttctcaaaaatgcaggtaatgaagcggttcacgaagggattgaagatagtcaaaaagcaattacggcaatgattgcagcttggcagctttctatttggtttgttcgtacctttggcgataatatggcaaattttgagcctgtaccgttttgtccggattatttacaagcggtaagaaacaatgaaaatcttgcaaaatacactgaaaatccgaccgcttctcaacaggaagaacagcaattagtcgaagctaatcaagcagaaattcaagccatttccaccgcactttcaaaccaaagcgaagaagaaaaacaagcctttgatgtggcgcgcgaaaaacgtgcagcacaagcctttgagcgtttgaagaattatgaattacgtttgttggacgaaaaacaaactcgtcttttgatgattgaccctatgttgcgagaagccggctgggaagccgatagtgaaaatttggattatcgaaaaggtgttcgccctgaaaaaggacgttatcttgccattgctgaatatccggtggggaaagatcgtgcagattatgtgcttttttgtgggttagtgcctgtagccattgtggaagcaaaaaaggcgaatgtgaatgttgccggtaaagttgcacaagcggagcgttatgcgaaacagtttgagatcacagaaaatttaaccgcaccttgggtgttggcgaaacggactgtcgcttgggcttcagatgaaagtgccaatgatggcttgcatttttatgtaccctttgtgtattcctgtaatggtaaaccttatcttaagcaacagctagaactgtcggggacgtggtttagagatgttcgtcagccgtctaatcttaagcgtgcgttacaacaatttcatacaccagatgtattattggaaatgttaaaaaaagatgaagaacaagcaacgcaaaaactcgaaaatgaaccctttgatttcttggggctacgaccttatcaagagaaagctatccaagcggtagagcagaacttgagtgagggtaaacgagaaatgttgctggcaatggcaacgggaacagggaaaactcggacaattacaggattaattcaccgctttttaaaaacggatcgttttcgccgaattctttttttggtggatagaaccgcactggcggagcaagcggaagatacctttggtgggatgaacgtggaacccaaccaaaccttaaatacgttgtataactttgcggtgaatggtgtggttgaacctgaaacgaaagtgaaggtggcgacggtacaatctttggtaaaacagattttttattcgggcgaagctccggcaattgatcaatttgactgtattattgtggacgaagcccatcgtggctatacgcttgatcaagaaatgacagatggtgagttagaatttcaagataatgagcaatatttatccacgtatcgccgagtgttagattattttgatgcagtaaaaattggtttgacggcaacccctgctctacacaccaaagaaatttttggtgagcctgtttttgtctattcttacaaagaagcggtgattgatgattatttggtcgatcacgagcctccgatagagattaagacgaaacttaatcaagatggtattcattttgagcgtggcgagcagttagaatttatcgacaccggtacaggtgaagtggtattaagtgaacttgccgatgagcaaaattttgatgtagagagttttaatcgcacggtattaaatgacagttttaatcaagtggtttgtgaagttttactggattatcttgatccttttggcagcgaaaaaaccttgattttctgtgcgacagatctacacgctgataagattaaaggcatattagataccttattcaaacaaaaatatggtgatgagtataataccaatgccgtggcgaaaattacggggcaagcggataaacctaatacgcttatcaaatattttaaaaacgaacgttacccgaatatcgccattacggtggatttgctttctacggggattgatgtaccggagatttgcaatttagtctttttacgccgtgtaaaatctcgtgtgctttatgaacagatgaaaggtcgagcgacacgtaaatgtgaagcattaggtaaaagcgtgttccatatttacgatgcagtgggtttatgccgagcaatggcaagtgtggataccatgaaaccgatagtgaagaacgttcatcaacccatttcgcaattagtggaagaattacaagcggtaggaaaaattgaaaataatgcaaacccactagccaatgaacatcagcaggcattacttgaacaaattagccaaaaaattatgcgattgctgcgtaaagcggacaaaatggcagaaaaaagcccacagatgaaggaaaatctcgctattcttgaacaggaatggggcgtaaaacctaatttgttgcataaacatttgcttaagattggcgttcaaggggcggtacaatttttcgaaaaacatcgcaatatcttaaccgaatttaaccgcttgcaagctatgttaccaagcgaacgaatgctggtgatttctacgcacgaagatgaagtgcgagaaattaccccaatctacggaaagggcgaaagtgcggacgattatttgcaagaatttatggcctatattcaacagcatagtaacgacagtgttgcgatacaggtaattattaaccgccctcgcaatcttactcgtcagcagcttaaagagattgagcttgctttagatgcacaggggtttagtaaagcgaaactgaataaagcaatggggcaaaaaacgaaccgtcaaattaccgccggtattgtggcgcatatccgccgtgcggcgattggcgacagtcttgttccttttgaacagcgtgttgatcatgcgattgaaaaattgtgccaagcacattcatttaaacccaaccaacaaaaatggttagaacggatcgcaaaacagcttaaacaaaatcacgatgaaatcttagatcgtagtcgtttaaccgagctattccaagggcaatttagtggtattcgagccgaatttggtgaaacattagatgagttattggcagaattaaatgaggggctatgggataaaatagggtagatttgaatgcttaagcaaaacttaagctaagcggtcgaaaaacatctaaattttgtaaattaattagaatagtagatagtgcaagtgatgttggtaaaaggtaaataatgtgatttatccaaaagagattattgagttatacgaacaattgtgtttgcaagaaagtgaaagccaacgaatagaagctaaacgatgttcagatactgttagtgattcagttatgcaaacagtatgtgcttttgcaaatgaagtcggtttggaatatggttatttattactaggagttagtgagcctgatgatgagcataaaaattattgggtttcaggtgtttctgactctgatcgtgtattagatcaaattcaaacaaattgtcgtaatcaatttaaagttgtagttaatattgatgcaggaatggcaattattgaaaataaaacggtaattgctgtaaaagtatttgaattagatccagcttctaaaccttgtagctttttatctagtggaaaaaataaaaagaattttactaaaacaggcatttggcgaagaggacttaatggagattatgaagccacggtagatgagttacaaagcatttattctcaaaaacaagggctttcttacgaaaatacgtttttacccaatgttacttgggatgatattgatcctgaaaaaatagaggagtatcgtcgtttacgtaggaaagtgcgacaagactctccagagttagattatgatgatgtgactttacttgatacatttaatttaattcgccaaaaagatggtgctattcagccaaatattgcggggttattgttatttggtacaaatgttgcattaagaaaacatttaccaatgattagagtggattatattaggcatcgaggttctcaatggatcgatgatgaacagcgttttctttacaccaaagattttagagaatctctattgactttaatacctcgtttagaagcaatgatcttagacgatataccagaatattttaatttggaagaaaatgctttacaaagaacagatagaccatttttaccacaaaaagttgtgcgtgaagcggtggttaatatggttatgcatagagattatgctgtaaatcagccctcgcaagttaatcgctttagtaatcgtcttgaattacaaaatgcaggatattctttaaaaccattagaagatttaggaaatgcaaaatctattactcgaaacccattaattgctgcggttttgtatgatttaaaatttgcagaaacaaaaggtagtggtgtaaacactatgcgttccttgctaaaaaaggcaaaacttagcccacctgtttttcacagtaatcaagataataatcaatttaaagcgacactgttgttacaacatttgatgcgtgaagagcaattagaatggctaaaattattttcagaatataatttatcggataatgaagctgttgcgttggtattagctcgagaaacgggttttgttgataattcaggcctaagggaaatatcaggtcttgatacattagcagcaagtaaattacttggtaagttaagagataaacatcttttagataagtttggaaaaggacaatatactttttatctgctatcagacttagcatctaatatagatgacaaacctactaagctagatgataaacctactaagctagatgataaacctactaagctagatgacaaacctactaagctagatgataaacctactaagctagatgataaacctactaagctagatgacaaacctactaagttagatgagttacttgaggatttaggtaatagaagttcttttggacaaattagtatagtgattgcaatgttgtgtttagaacagccttgttcagcagagtttattgctgaaaaattaaatagaaatcagcaatatgtatccaaaaattacttgaaaaaactaattgatagttggtatctcacttatatttatcccgaacaaccaaatcatccagagcaagcctatcgaacaacagataaaggcagagaatggctgaccgaaaaaggaattattaatgacaaacaatgaaatagtccaaaaactttggaatttgtgtgatgtgctacgtgatgatggcattaactacaacgactatttaaccgaattggtgatgttgctgtttattaaaatggtgcacgaaaaagagcaattatttattgaagagaaaacggaatttaaaccgttattacccgaaggctgccgttgggaagatttaagcggtaaatcaggtatcaatcttttagataactatcgccgtatgttgcttgtgctttcaacgggtaaagaaaatgatgagatcgttcataataacccgttattgttagcgatttatgccaatgcaaaaacctcattaacgcaaccaaagcatttagagcaattagtgcgtaactttgatgaaatggattggttctcggcgcaaaaagatggtttgggcgatttatatgagggattgcttgaaaagaatgccactgaaacgaaatcaggtgcagggcaatattttacgccacgtgcattgattaatttgatggtgcgttgtattaaccccgtggttggagaggtaattcaagatcctgccgctggaacagccggctttttgattgctgccgaccaatatatgcgcaacaaaaccgatgattattttgatttaagcgaacaagatcgtcattttcaaattcacgaagcctttaaaggggtggagttagtgaccaatactcgtcgccttgcgttaatgaactgtttattacacggtattgaaggtggttcagaaggggcggttattcaaggtaacagcttaggtgatgtaggcaaaaatttaaaacctgctgatattatccttgcgaatccgccatttggcaccagtaaaggcggtgatgcggcgataacccgtgatgatttaacctttgaaacgactaataaacagctggctttcttgcagcatatctatcgtaatttaaaagaaggtggacgcgcggcggtagtgttgccggataatgttttgtttgaagccggtaaagggacggatattcgcaaagatttaatggataaatgtcatttgcatacgattttgcgtttaccaacggggattttttatgctcagggtgtgaaaactaatgtgctgttttttgacaaagtcagtaacgatgcggaaaattcaactcaaaaaacgtgggtttatgatttacgtacaaatatgccgagctttggtaaacgtactccgtttacagaaaaataccttgaagcctttgaaaaggtatttaatccgaccgagcttgatgtcaataaggcgaatataatgacgattttgagtgctcgccaagaaggggagtggagctataccgaaggggaacaaacagcggaaaatagccgttggaaatgttttgatcgtacttatattcgtgatgtaaaaggcgatagtttagatattagctggcttaaagataatgctgctgttagcagtgaagatttgcctgagccagaagagctgattgcggaagcaaaagccgaattggaagcagcccttgcagggttagatgaactattcgcagaattaaccacaaaataggataaacaaaatgttagccaaattagaccgcttgctccgtcaagcaaacattcctttgaccgatcagcaaaaacagcagttggttgatttcgtgaaattattggataaatggaacaaggcgtataacctcacttctgtgcgtaatcctgatgaaatgttggttaagcatattatggatagccttgtggtaagccaacatttacaggggcaacagtttattgatgtgggaacaggtccggggttaccgggtattccgctggcgatagctaatcccgacaaacagtttgtgttgttagacagcttaggcaaacgtattacctttatcaaaaatgctattcgagagctaaaactgactaatgtaacacctgtgttaagtcgggttgaagagtatcaagagcaacaatttgacggcgtattaagccgagcttttgcctctctaaatgatatggttgattggtgctaccatttaccgaatacaagcggtcatttttatgcgttaaaaggacaatatcagccagaagagttggcagaagtgggcaaaccgattgagttggtggacataattaaattgaacgtacctgagttagttggagagcgacatttggtggtattgaatagataataataggtacagtggtggtgtaatagacaaaatagttttcaaaaagtagattaattccttgtaatatagtgctaattcaacttttagtaaccattttgtctactatgttttttcttccaacccctatcttcctgccctcgccacaaacgctgaatattatcgtgatggcgatagactaatagacaacaaactaatgcgacagggaatgttaattcagggctaaaccaccaaatataaagtggaacgatcaatgctgtaataactgcacttagcgatgaataaccagaaatcaaaaaaacgaacaaccacgttcccaccgctaatccagcaactgaatagcccattggaatgattgctccaaaggcagttgcaacccctttgccacctcggaacttaaagaaaacggggaaaatatgtccaagacaagctgccaaagcaataaagccaatcaccgaaattggcagttctaaataaaaaccaagagaaacaggtagcataccttttaatatgtccgccattaaaacacctaatgccgataactttccgcctatgcgtaggacgtttgttgcccctgggttatgtgatccgtgttctcgtggatcgggtagtcctgctaatcgacaaaaaatgacggcacttgaaatagaaccaagcaaatatgcccctaaaatcagtaaataagcaataacgctcattttttccccttatttgttgcttactttgtgctatattttaccttaactttcaaaaagaaaaacaaggaaagatccgatgactgataaagtttttattcacgaactcaccgcttttgcctctattggggcttatgagtgggaacataccattaaacaacgtttagttttcaatattgaaatggcgtgggattttagccgagccgtcgcagatgatgatgtgcaatactgcttaaattatgcggaagtttcacaaaagattcttgattttgttgaaaatacaccgtttaagttggttgaaaccgttgcttatcgagtggccgaactactgcaacacgagtttggggtgaaatcattacgcattgaattacacaagcctaaagcagttgctcaatcctcaagtgttggtgtaattgttgaacgataaagcgtactattattactaaatgcgatctagatcacagttatcccattgatttctcattataattttcgcccctaatttttagcataaaggagcattctatgcctacaatgatcgatatccaagaacgtttaatcgaacttgttgcagaaaaacaaaaccctgttgttcaagcggttgtggagcagttaattcgacaaaacaataaagcatacttttctgcagaacaagtcaccacattttgtcaaacattcaacctatcccctgtcgaacttgctttagaatgcttacctattgcggcttgctacgccagagtgcctgtttctcatttttttgtaggggctgtggcgattggcaaatcagggaatttctattttggggcaaatcaagaatttgagagcgatgcgatgcaacaaactgttcacgcagagcaaagtgccgtttcacacgcttggatcgcaggggaaactgcattaaccgatatggtggtaaactacactccttgcggacactgtcgccaatttatgaatgaactcaatagtgctaaacaactaaaaattcatttaccacatagtcaaaataatttattacacagttacctgccagatgcttttggaccaaaagatttacagattgacaaggttttattcgatcctcaacaaaatggctttgaagcaagtgacgatgcgttacaacaagcggcaatttcggcggcaaatcttgcgtatgcgccttatagtaaagcggtgagtggggtagcattacagtgtggtgaacagattatcacgggacgctatgcagaaaatgcggcattcaatccaagtttcttgccgttacaaagtgctttaaatttccgtcgaatgcaaggtttagaaggtgtgacaatttcaagggttattcttgctgaaaaatatgcggtactcagccatcgagcaatgaccgagagtttggtaaaaaacttacttaacttaccgcttgaatatgtcaaactttaacaataatgttaagatcatcgcgaatatttcttagcagattttgattgaagctaaagaaatgtaaaataatgtatttatgatgctaaaaaacagagataaaatactacaactttgcaacatttgttcgctatcgtagtcatagtagcagagcaattcaaacaaactgaaggtaatctaatgcaaaatccacaaattcttattgttgaagatgaagctgttacgagaagtacattaaaaagcgtatttgaagcggaaggctatgatgtatttgaagccactgacggcaatgaaatgaacatcatcttagataatcacgaaattaaccttgtgattatggatatcaatttaccaggcaaaaatggcttaatgcttgctcgagaacttagagaaaacaccgatattgcattaatgtttttgactggacgtgataacgaagtggataaaattttagggctagagatcggggctgacgattacattactaagccgttcaatcctcgtgaactcaccattcgtgcaagaaatttactacaacgcacaatggaggaaaaagacaaaatagtcaaagatccacatcataccgaaagttatagctttaatggctggaccttagatgtaaatagtcgcagtttgattaaccctgaaaatgaggtaattaaacttcctcgtagtgagtttagagccttacttcacttctgtgaaaatccagggaaaatccagacacgtgaagatctgttaaaacgaatgacaggacgtgaattgaaacctcacgatcgtaccgttgatgtgacgatccgtcgtatccgtaaacactttgaagatcacccaaataccccagaaattatcgtgactattcacggtgaagggtatcggttctgtggggagttcgtttagttagtaaaaattaaaaatacggtcacacgtctaatatataaacattttaatagttatggaaacttagagagaatgcaataggaatagtcttattgcatttttagcatcatggctagttagtcttacatattattagaccttccttaagatattcttcgtcattattaaatttactccataaatgagtaaaatcgttaaaaatcataaagacttcttttatacccatgaatcattaggtgaaatatttatttgataactgtaatatatctcttttagagattatcatatataaattagttaataagtatattataaataattaagatatttttatggaaaaaatatattcagcccccattaccgtactcggtgccggttcatacggcactgcattggcgattgcactttctcgtaatgggcataaaacatacctttggggacataatccgcaaaaaatggctcaaatggctgtaaggcgtatgaatgaggagtttctacccggtattccatttccagaggcattagagattgaaagcgatcttgcaacggcattaactcgctcaaaagatattttaattgtcgtgcctagccacgttttttctgaagttctacaacaaattcaaccgttattaacttctgaacatcgtattatgtgggcgacaaaagggttagagcgagacactggaagattgttgcaagaagtggctttgcaaattttaggtgatcgctatccgctagcggtgctttctgggccgacttttgcaaaagagttagctcaaggattgccgactgctattgctctttcttccactgatcctcagtttgccgatgaaatgcaacagcgtattcattgctcaaaagcctttcgggtttatttgaatagtgatatggttggcgtacagctcggtggggcgattaaaaatgtgattgcgattggtacagggatttcagatggaatgggctttggggcaaatgctcgcactgcattaattacacggggattagcagagattagtcgtctagggctgtctttaggggcaaatcccaccacctttataggtatggcagggcttggtgatttggtgctaacctgtaccgacaatcaatctcgcaaccgccgttttggtttaatgcttggacaagggagaaatgctcaagaggcgatggctgaaattgggcaagtcgttgaagggttttataataccaaagaagcctatttactggctcaaaaacaaggcattgagatgccgattgtggaacaaatttatcagattttgttctgtggcaagcacgccagtgatgttgctaaaacgcttttaggtcgtgaacgaaaaggggaataaagatgacaaaccaaccgcttgatcttatttggcagaatattcgtaatgaagcacaagagcttgtaaatagtgagccgatgcttgccagtttttttcacgcaaccattctgaaacatcatcatttaggcgatgcgttaagctatattttggcaaacaaactggcaaatgcgattatgccggcaattgcattaaaagagatcattgaagaagcctatcaagcagatccgcaaattattgccagtgctgcctgcgatattgaagctgttcgtactcgagatcctgcggtcgataaatggagtacgcctttgctttatctcaaaggttatcacgctttgcaaagctatagagtcacccattatttgtggcaacaagggcgaaaagctttggctatttatctgcaaaatgagatttccgttgcttttgatgtggatattcaccctgcggctagtgttggttgtggcattatgttagaccacgccacggggattgtggtgggagaaacggcagtgatcgaaaacgatgtgtctattttgcaaggtgtaacgctaggtggtacaggtaaagaacacggagatcgccacccgaaaattcgtgaaggcgtgatgattggggctggggctaaaattttaggtaatattgagattggtcgttactcaaaaattggggcaaattcggttgtattacaagcggtgcctgaatatgccactgcggctggtgtccctgctcgaattattgggcattctcaacaacaaaaacccgcttttgaaatgaatcaatattttgatgataccaataaagagatcaattgagatagatattaaataatggggctgacctagattagtatgctagctaatctaggtcagccccttaaatttggcatagtagacaaattagcccactttttatcaacacttttgtctactatacctaattataggtgctagattaccacacaaaacctacccctcctccaatcatagtatcccgctgagtattactgctaacagacgctcgaataagccatttgccattatcagaaattctggaataacctatagcataggcagattgcccgcgatattgtgcattagaaacagaaatagcacttttacctggtaaagaaatttgtggcaaattagccatcgccccagcagaagcaatacccgctcttgcattaacatcaacacgaccaatatctcttgataattgattaaatcctgtattcacagaagaaaccactttgttgagctgacgaacattcacaatatcgccctcagcactaccatctccaatgttggtaattctggcgccattcatatttacaactggatttccttgcttatctttacctaaagatactttcgtatcgccattactaattgaagtaatgtcgcttaaatctccagacacgctcacattgtaaatattctgaccatttgcccccgtttttgaagtcactttcacatttttacccgcttcaacttcagttcttgcggctgcggttgcggtattaattgctactgcgacttcatctcctgtcgcaaaatggttgcttttatctgctgcactaatggtgcgtttatccttagaggcagtgagtttcgttttagcaaccgccaaatcatacacgatttgctgattatcgccctgacgctctttaatcaccacactgtgatcggtagattccacttcagttttcgcagatttcaactgtttcacattaacagcgtccgtatctgctaccccttcagcgacattacctaataccatcggagtttcatttgccaaattcacttttactgctaatgacttaagcgtaatactgccatctggattttgcgttttggttgagaatttacctttaacattcaccactggaattaacttaatcgaaccatctttagcaggttcttccaaatagaaattacctcccatattgataattgatttgccgtcttccgttgtatactccatcggtaaaccgctgacactcacatttcctcgctcacccttaggtccctgaatacccgctgttccctgcggtccttgtggtcccgttggacccgcaggtccttgaataccttgttcacctttaggaccctgttcacccctaggccccgttggacccgcagggccttgagggccctctggtcctgcttcaccacggtcacccctatcgccttttgctcctgcctctccttttggacccacaggaccagtttctcctttatctcccctaggaccctgcttgcctggctcacccgcaggtcctcgtggtcccgctggacccgctgggcctatttctcctcgctcacccgcagggccagcttcacctttctgaccggtatcacctttatctcccctaggaccctgctcgcctggctctcccgctgggcctgccggacccacagggccagttgcacccacaggcccttgagggcctactggtcctgcttcaccagtgtcacccttttcgccttttgctcctgcctctccttttggacccgcagggccagtttcacctcttagaccttgttcgcctttatcccccttaggaccaggtgcaccttgtggtccaattggacctgctggacccgcaggaccagtttcacctttatctcccctaggaccctgctcgcctcgctctcccgctgggcctgccggaccaggttcacctttctctcccctaggacctggaactccattatctccttttggaccttgtggtcctgttgctccagcaggaccagcttcgcctctaggacctgcatcaccttttggaccagcaggccccattggacctgtatctcctttttgaccctgttcacccttagcccctgttggacccgcaggaccagtttctcctcggtcacccctaggccctgctgggcccgcaggtccagctgcacctgcagggcctcgtggtcctgctggacccgcagggccagttgcaccttgttcccccctaggaccctgctcgcctcgctctcccgctggtcctgctggacccactggacctgttggaccagtttcgccttttggtcctggatcacctttctcacccttaggtccatctgcacctgcagggcctcgctcacccttaggtccctgagcacccgctgttccctgtggtcctcgtggccctactggacccgcaggtccagttgcacccgtaggaccttgagggcccactgctcctgctggaccagcaggaccagctgcacctgcagggccagtttctcctcgctcacccctaggacctactggacccgcaggacctgctggacccgctgggccagtttcacctctatcgccttttagacctttttcaccacgatctcctttttcacctttctgaccagtatcacctttgtcacccttaggtccagctgcacctgcaggtcctcgtggtcctgctggacccgtaggtccttgaataccttgtttaccttcaggaccctgttcacccttagcccctgttggacccgcagggccagtttctcctcgctcacccgcagggcctcgctctcccgctggacctgctggaccagcagcccctgctggacccactggaccaatcggacccgcagggcctgtttcacctcttagacctcgctcgccacgatctcctttttcacctttcttgataatgttatgcgaattatctgtatagataatttttagatcgccattttctaggctttcagtcgttttaattaacttaccaatcgtagaaatcgtaatatttccgcccgcttgttctaatttaatattatttccagcggtaaaggttacggtatcgtttattttgataagatgtgccccaggtggagttgcttgaccccccgttcctggagcaattgcaagtttccaaccagcatttgaaaattgcatgtagttcaccgcatcgctattttgtgtacctcgtgctaaattggtgatcttaactgaggaagtgccgtctgtacctgttacttttagattaccgtcagtggtgctggtaatcttaggtccattatcgccatattgaacgctgctgaatgttggtgtctctttcatcaacacatggaattctagatttctacgataaatttcaatgttatcgcctttgtatcgaacaccaccgttttggtatgtttcgttacttgcaatggtaacggtctcatctttgttggcattccatttttgacccaaagcatcatttgttgtacctgtatctgttttttcgcctttgaatatcaaacttcctgctctggcatcagctaatttatttttaatcgtatcgtctagtgatattgtaatggttgagccagacgcattggtcttgatttcgtcatttgtgcctagcactgtaagcgtaccatcccacaaccccacttttggctgtggattagcattggtatcaccaccaattttcatcgtcaaagatttaagctgtgccacgtttaccgcatcggtatcttgtgtaccagccgccacattgacgatttggcgtttgatggttgtaccgcccacagaaactgcaccaatattattaccatcaaccttttgtgtggatttaaagccgttagtgtcactgctttcttccgttgtgacagaatgagtttgttttaacccctctacaccgccatctgtatttgcattagatccataacccaatgccacccacgctgacaacggtattattaccaagtgcggttgctctgtctgttgttgtacttgcctcttcacccacagcaacagagtggttaccagtggcagaggctttataacccatcgcaataccataatttccagccgcagaggcatttacccccgctgttattgcataggttcctgtagctccagctttgtcagtaattgtgccgaaattagtcgcaggttctccctgaccttgagactgatcgtcatagttagtatgaaaatacgtttttgggccagtaatggtaatttttgtcttgccatttccctgctcaactgccgtactaataccatcagcccctacaattgagagcgtttcattagaaaatgttgtgtgacccgtcgtacctccatcgccactgatctttaaagtcagtgcttttaattgtgctacgtttgctgcgtcagtatctgctgtacctgcagcaacactggtaatttgacgagtgacggaggtgtcattacctactgttaccgctgcatgcgtagcagataatgtacttccgttaatagaataatttgtattatctggtgtccaacctgcttgccctgaatcacgactagtactggattgataacctagagcaacgccatatttcatatctgctctcgcattattccccaatgctgttgcacgctctgcggttgcttttgcgttttcaccgaatgcggaagctcctacttgacttgcagtagcacttttaccaaaagcaatggcgtagcttccagcatttgcattaccaccaaccgcaataccgtaatcagcggtagacttactactcgcaccgatagcaatgccttcaacattacttgcatatgctataggacctacaacaatagatccttcgcccacagccacagacatacccccaatagcaatagaggctttaccaatcgtagttgttgttctggaatagttactattttgatatttcgttgtatttaaatcatctccaccgattgatatggagccatacccctccgctttgacatctgccccgatagcaatagattgtgacttacttgcactagcaaggttacctattgcaattgcttgttcacctgtcgcacgggccccttcgcctaagatagcagttctcccttccgcttctgaactactcccgatggcaattaatactagacttaaaagacttaatttaaatttatcttgctgtttatctaaaaaataatctgaagtgcatacttgagctcttttatccgtgcaagtggatgttttagtatgagactttactaactcagatacaaccacccaagcctgttgagcatgactccaaataactctaaatattttattcataataaacttttctactacttttcctaataaaacatcgtaaacctttatttacattttcaggatgcacaaatgcccccatcgtccaaacgaaaggggaaatctcaaaaatatctttcccccacctcattgtaaaaaaaaaaaaaaaacaatgcgttgcacaaaactaagaataaaataacaaggatttttcaacttttatcaataaaagctagaaataataggcggaaatctaatgaaagcggtgatttagataaggtatctattaaaactgatacaccaaattcacgaccaaagaaggtcacgtctgaaataatattgagataggtttgttgtaaaggaattaatttagctttgggggatttttcaatataacgttgaatagttctaatggaacagtgatatttttggatattgttcttaaggcaaaaaggacaggtttttgttcatatttcaaaaagtgggcttaaaaccttgtgctataaggctttagcccactttttaccaacgcttttgtctactatgccttaaattttatatgctcattgataacataaagagagtacctagtagctttttcatagtttagtccttgttataaggttgaagtaaaagctggaagccattcttccgcacttccatcatggtcaaaattattcaccacgtcaatgcgtagagattcgcatacttgtgtcgcccctttggcagttaagccttgctcaacaagattgacggcattgcagaaagtgtcgtaatcggaactgcctaatccgacaaccccaaatttcatctggctgagatcaagattgctttcggcaagttgttggaaaaggggttggatattttcaggcagttctcctgcaccgtgtgttgatgtgacgactaacagggcagtttgatgttgaatatcggctaattcggcttggttaaacagtccaacctgatagccttgttcagtgagaacatcattgagatgatcggcgacatactccgcaccgcctaaggtgctaccggtgatgatacaaatagatttcgacatagcatactcatattgtaaaaaaatcgacttattctagaagaattgttataaagaataaagcagttttacatcaaggaaagagaatatgagccgtattacattgttagttccaaataaaacatatcaagcagaagtgatggcatatcgacaggctttttcaaataatgcaattgatggcggagcaatgttagagaaatttgatgatttctctcaatggctggattatttagcacaacctgaaggctatctgaccgcttggggatttaacaaggtgcaagactcgacctatcttgcgtggcatacacaattacatcgagtggttggaataattaatatccgccacaatctcaataacgactatctgcgacaatttggcggacatatcgggtattccatacaccctgactttcgcaagcaaggctacggctcggaaatgttgaaattagctttagcaaaggtaaaaacgctgggcttggataaagtgctaattacctgtgaaaaaagtaatgttggttctgaaaaggtgattttaaataacggtggaaagtttgagtctattgttgagctcaatcaagtcaaaagaatgaaacggttttggattgaggtgttgtaatatatatttgtaggggcggaccgatgtgtccgcccataaaattttcagtagcttattttcactatttcccaaccaactccgctcttacaatcgaagccccttggctcaaagcattgagttttgcacgagcgatgtggcgtggcataggtgccattccgcagttggtgcttgggtagagtttatctgcatcaacaaattgcaacgctttgcggagcgtatctgcgacttgttctggcgtttcgactacgttggtggcaacatcaattaccccgaccatcacgattttgccacgcactaattcgagcaagtccatcggtacttttgaattttggcattcaagtgagatgatgtcgattttagattgttgcagtttcgggaagctctcttcgtattgacgccattcgttgccgagtgtttgcttccagtcggtgttagctttgataccgtagccatagcagatatgcacagccgtttggcacttcaagctttccgccgcacgctctagtgccgctaccccccagtcgttaagctcgtcaaaaaagacgttaaatgcgggttcgtcaaattgaataatatccacgcctgccgcttctaactcttttgcttcttcattgagaattttggcaaattcccaagctaatttttcacggcttttgtagtgaccatcatacagcgtgtcgatcattgtcatagggccaggtaacgcccatttgatcggcttatcggtgtgctggcgtaggaatttcgcatcttctacaaatacagattttggacggcgaaccgttccaaccacactgggtacacttgcatcatagcgattgcggatccgcacgatttcacgcttggtaaaatccacgccttctaaatgttcaataaaagttgtcacaaagtgctgacgggtctgctcgccatcgctgacaatatcaattccagttgcattttgctccgcaagagcaattaacaacgcatcacgtttcgcttgtaacagctcatcaccactgaatttccattcagaccacagtttttcaggctcagcaagccaaaagggtttcggcagactgcccgcagtagaagtaggtaaaagaattttgctcattatttatgttgtcctttatttattatttttcatttaaccaagagtctaacaccgttttataaggcttgatgaaatgctcttcggcatatttaccttgttggacggcaagttgagctcgttcgacacggtcatattcaactttagtcagagaataatctttactcgtcaggctaggtttgtaaacctgccctgccaccgagttagcgttatatatttctgggcggtagattttctggaacgcttccatagttgcaatggtgctgattagctctatgttggtatagtcattcagcaagtccgctttttcatcaaaatagaacgcatagggtgcgacggattttggtggcataaagtaacgcactttcaagcccatttttgcaaagtaggcatcggttagcgagtagtcgttttgttcatattccacgcccaaaatcgggtgaatattggtcgttttgtggtaagtacgagtggttgctacgctcaagcagatcactggtggctttttgaattgtgcggtatattcaggtgaagccaacaaatatttgaacaatttgccgtgcagatcgccgtagccttccggcacggtaaattcaggcttatctttgttgcgatcgatcagtaacacactgaaatcgtagtcacgcacaaaagaagaaaagctgttgcccacaatgccgtcaatggttttacccgtttttttatcaatcacagatgttttgagccattctaacgctgagaaaaatttgcctgtaccttctacatcaatatcaatcgaaacaatatccaaattgacggagtaacgatccgaagtgggattatcccagttcgccaaatcgttaaaacgtttatcgatcattgcaatagcgttttgcaggttttctttacggttctcgccacgggcaaggttggcaaagttggtggttaagcgagtgctgttcgctggttcatagttttcatcaaatctttcagtatgcacacggcattggaattgggttgtcattctattcttcctactcattttgttaagataatgtgaattaaatcacaactttctattgaataaaaatgatagattttggtgtttattatgaaaataattcaagtttgatggtgagggagatatagttcatattgagaaatcaaagattatgcaaagatataaccccctctttcgttctttttttgtataatgccaacatttcatccctgacttcctttccctcgcaagcgggggaaggtgccgaaggcggaaggggggatataagcggtcagattaagccaaaattttgcaaatagagaaaagattatgtttgagaacctatccgacagactatccaaaaccctaaaaaacattacggggaaagggcgtttaaccgaagataacattaaagataccctgcgtgaagtgcgtatggcattgttagaagccgatgtggctttgcctgtggtgcgtgagtttatcaataaagtcaaagagcgtgctattggcgaagaagtcaataaaagcttaacaccagggcaagagttcctaaaaatcgtgcaagctgagcttgaaaaagcgatgggcgaagcaaatgaagggctgaaccttgccacccaaccgccagcggtaattttaatggctggtttgcagggggcaggtaaaacgacctctgttggtaaattggcgaaattcttaaaagaacgccataagaaaaaagtgcttgtggtgtctgctgacgtttatcgtccagcggcgattaaacagcttcaaacgttggctgaagcgttaaaagttgatttcttcccgacagaaacgtcgcaaaaaccggtagacattgccgaagcagcattgaaacacgccaaactcaatttctttgatgtgttaattgtcgataccgcaggtcgcttgcacgttgatggcgagatgatggaagagatccagcaaattcactcggtgttaaacccaattgaaaccttgtttactgtcgatgcaatgacaggtcaagatgcggcaaacacggcaaaagcctttaatgaagccttgccgcttacaggggtgattttaaccaaagtcgatggtgatgctcgtggtggtgcggcgttatctattcgtcaaattacaggcaagccgattaaattcttaggggttggcgagaaaaccgatgcccttgagccgttccaccctgatcgtatcgcttcacgcattttaggtatgggcgatgtgctatcgttgattgaagacttacaacgttctgtcgatcaggaaaaagccgaaaaaatggcggcgaaattcaagaaaggcgatgattttacccttgatgatttccgtgaacagttggtggaaatgaaaaaaatgggcggtatgatgtcgatgcttgataaattacctggggcgaagaatttaccggatcacgttaaaaatcaagtcgatgacaaaatgttcatcaaaatggaagcaatcatcaactcaatgaccctgaaagagcgtgctaaccctgacattatcaaaggttcacgccgtcgccgtattgcgttaggttcaggaacgcaagtgcaagatgtgaataaactgctcaaacagtttgacgaaatgcaacgtatgatgaaaaaaatgcgtaaaggcggtatggcgaaaatgatgcgtggtatgaaaggaatgatgggcggtggtcttggtggtttaggtggaatgtttggaaagagatagtattattgaacaagatgtataagatatagataacagtggtgccgactaccggaatcgaactggtgacctactgattacaagtcagttgctctacctactgagctaagtcggcattagataagatgtcttgaaaagagcgtgtattgtagttatttttgttaaagttgcaagctctacctgtctaatttgataaaaaatagcagggcaagatcgcatctttctcaaatttatgatctaatataccttaattatccatatcaaatcaggttgtaaaatgagcgtttttcgtttttttgaaaatttatccgacctacgagcctataatcaaaaacaccactttttagacatcgtttttctcgtcgtcagtgccgtgatgtcgggggcaaacagctggactgaaatcaaactttttggcgaattacatttggattggttgcgaaaatatcgtccttttgagtgtggcattcctgtcgatgatactatcgctcgtgtaataaaacgcattaaatgcttgagacgtttgaggaggtaaatgcggaacgtcgtcgaattgatgagcgttactaccgtaagctgaaagtgagtgattggctgagcaaagcggaggaatggaaggggataaaatcggtgttggaggtgtgtcgcaagcggtcagataatggcaaagaatcgcaagaaaaagtcttttatatcagtagtttggatgttgatattcaaatattggcgaagtgcgtgcgagggcattgggaagtggaaaacaaagcccattgggtgctagatgtggtctataaagaagacgaatgtgctgtgactgatgaatggggtgcggaaaatctggcaatcttgcgtcgattagcgttgaacttggcacgattacacccgaaaaagcagagtatgaaagggaaattgaccgctgctggttggtcagatgaatttcgagatgagctgttgctcggcgtgtaggttgaaaaatggacaacatatatggttgccctggtgctttaaaacgatattatgcataccaatcaaacaaaagaccgaaaatataggattaaaatagggtattttttgatcagattatctatttttttctattttttcgacgagtatcacaaaaataacacctccaaccaattgcattattcttgctaaaagcgattattttactgagtgactaaatgctcaatcgtcacgtgtaaaaatgtatcgcaaacgaggttttttttatgaaatacattgatgtaaaaacacaacacattagaaatttgctttatcctataattggagaaactcaagcaaaaacatatttttcctactatggaataatgaaagatggagctctgtttgctctatataaaaatagtaaattctatcttcatatctcaggaaactgtctacatgaagtactaactaatcccaatatatcccaactgtccgactctaaatatggtatcaattctaaatctttctatttgattccaacagaaattttatatgatttaaaacccatctcccattggataaccaatggtattcaagagattataaatacaaaacacacccaatatataaaaaagaaaagatgtatccgtaccttacctaatatgactattcaactagaaaggacattgaaaaagttaggtatcaactccatcgatgaactgattgatagaggtgaagtggatatattcgttaatcttcttaagatgggtatagatgctgatcaagctattttgttccgtctttatggagcaattaatcgacaatatatttatactatctctgataagactaagcaggatctacttaatgatgcaaatcatgctctatatgaggctggcttacgtaagcgcttcaatgttaaataacacctgcttcttatgttggatttatgatccatatcacaaaaactaaaaaaacaaataaggaatggatattttccattcctttatttctagtagaatgctaggattcaactatcaatattattatccattttactaggagaaaccctaatgacattccgtattgaaaaagacacgatgggcgaagtgcaagtaccggcagacaaatattgggctgcacaaactgagcgttcacgcaataacttcaaaattggacctgaagcatcaatgccgaaagaaatcattgaagcattcggttatttgaaaaaagcagccgcttacgcaaaccacgatttaggcgtactttctgctgaaaaacgtgatttaatcgctcaagcctgcgatgaaattttagcgaataaattagatgatcaattcccattggtaatctggcaaacaggttcaggtacacaatctaatatgaacgtgaatgaagtggtttcaaaccgtgcgcacgttttaaacggtggtaaacttggcgagaaatcgattattcacccaaatgatgatgtgaataaatcacaatcttcaaacgacacttacccaacagcgatgcacattgcggcatacaaaaaagtggttgaacatacccttccttgcgtaaaacgtttacaaaaaactttagctgacaaagcagcagcattccaagatgtggtgaaaatcggtcgtactcacttaatggacgcaacaccattaacattaggtcaagagttctctgcttatgcagcacaattagctttcggtatcaaagcgttagaaaatacgttaccgcacttagcagaattagcattaggtggtacagcggtaggtacaggcttaaatacaccaacaggctacgatgtgaaagttgcagattatattgcgaaattcacaggtttaccgttcgtgactgcacaaaacaaatttgaagcactcgcaacacacgatgcaatcgttgaaactcacggtgcattaaaacaattagcagtttcactttataaaatcgctaacgatgtacgtttattagcatctggcccacgttcaggtatcggcgaaatcttaatccctgaaaatgaaccaggttcatcaattatgccgggtaaagtaaacccaactcaatgtgaagcaatgacaatggtttgcgcacaagtgttaggtaacgatgtaacaatttcatttgctggtacacaaggtcacttccaattaaacgtgtataaaccagtaatggcgtacaacttcttacaatctgcgcaattattaggcgatgcgtgcgtatcattcgatgaacactgtgcaatcggtattgaaccgaactatccacgcattaaacagcaattagatcaatctctaatgcttgtaactgcattgaatacccatatcggttatgaaaatgcagcgaaaattgcgaaaactgcacacaaaaacggtacaacactcaaagaagaagcgatcaacttaggtttagtaacagctgaacaatttgatgagtgggtacgccctgaagatatggttggaagtttgaaataactgcttccatagcatgggtttgattttaaagcaaatttatatttaaaacatttttaaaggcatttttatattaattccaatatagaaatgccatttattctatcaatatttccaaatttcgattagaatctcaccgcttacacattcttattataatttgttcaaatttagaggaagaactatgtccaaaccaatgaactttgtgatgatttcccctcactttccaaccaattttgaaacctttgcagtaagattgcgtgaaagtcggtttaatactttgggaattgcagacacaccttacgaacaattaagcgaaggcttacgcaactcactaactgagtattatcgtgtggataatatggaagactatgagcaagtttaccgtgcggtcggttattttgcgcataaatacggtcgcattgaccgtgttgagtcgcacaacgaatactggcttgagttagacgcaaaattgcgtaccgatttcaacgtacctggctataaaaatgaagatatgttggcaatcaaaactaaagctcagatgaaagaagtattccgcaaagctggcttaaaagtggcgaaaggccgtgtatttaaagatgatgaagatgcacgcaaactggctaaagaactcaaattccctgtgatcatcaaaccaaactcaggtgttggggcgagcgatacctacaaaatcaaatctgcagacgaattagaagctttcttcggctataaaaatgctcacgttgaatacattatggaagagtttatcgaaggcgatatcgtgacttttgacggtttaaccgataaagacggcaatatcgtgttctactcaagccttgagtattctgaagtggtattagaaacggtcgaaaaagataacgatatgttctactacattccacgcgaaatcaaagaagatttagttaaactcggacagaaatgtgtggacgcattcaaagttcgtgaacgtttcttccactttgaatatttccgtgtgaagaaaactggcgaattaatgccacttgaaatcaactgtcgtccaccaggtggtttaaccattgatatgtggaactatgcaaacgattttgacgtattcagagagtatgcgaatatcgttaaagagaacaaattctactcaaatattacacacccttggaatgtggtttatattgcgcgtaaagcgaataaaaactacaaacacaccattgatgaagtatgtcaaaaatatgcgggtaacattatcagtgttcaaaccgtaccaggtgttttcgctaaaattatgggcgaacacggtattttggctcgtactgaaacaatggaacaaatgcgtgaaattgcacgctttgcccaagagaagcagtaatttatctcatattttcctttcctaaggaaaattatcaagtagggacacactgcgtgtgtccactctatttttagaatttgacagtagcggacacacgcagtgtgtccctactgatatataaaggacaacaatcaatgcactttgaaagacgtagccactggagtggtgaactaggacgtgaaatgcatttcaacgtctatggacacgcaggcaaaccagttatcgtattcccatcatcaggtggcaaccaaaacgaatacggcaattttggtatgatcgaagcctgccgttcttttattgatcgtggcttaagtaaattctataccccagactcttttgacagcgaatcttggcttgcagaatggaaatcgggacacgatatggcacaggctcataacgcttacgaccgttatatcatcaatgaatttgttccgttaattcgccacgaatctcagtgggagggagcaatgatcgcaacaggttgcagtatgggggcttaccatacgatcaactttgcattacgccacccagatctgtttgatactgcaattgctttaagtggtgtttacgatgctcgtttctttacaaaagagttttacggcgatcttgcaattcacattaattcaccgattgattacctttggaatcaacacgatagctggttcttagatcgttatcgtcaaaatcattatatcgttgccgtaggacaaggtgcgtgggaagctcaacacgttgaagacactcgtcgtctgcaagatgcctttgctagcaaaggtattcaaggctggttcgactactggggacacgatatggcacacgactggcctttatggcgtatgcaaatgccttatttccttgggaagttggaagagcagggaattatttacacctgattctctacgggctgtaaatccaacaaggatattttaaatggattattttcactataaaaaccaacaacttttcgcagaagatgtcgccattacagacattattgcgcagcatggcacaccagcttatatttactctcgggcaacacttgaacgccattggcatgcttttgataaggcatttggtgatcacccacacttaatttgcttcgcagtcaaatctaactctaaccttgccctgctaaatgtaatggctcgtttaggctcaggctttgacattgtttctcaaggggaattagagcgagtattagctgcagggggggatgcaagtaaagtggttttctctggggtggcaaaaacgcatagagaaattgctcgtgctttagaagttggcattcgttgttttaatgttgagtcggtttctgaattaaaacgcattaacgaagttgcaggacaacttggtaagattgccccaatttcattacgtgtaaatccagatgtcgatgctaaaactcacccttatatttcgacagggttaaaagaaaataaatttggtgtaagtgtcaaagaggctcgtgaagtttatcgttttgctactaccttacctcatgtaaaaattacaggaatggattgccatattggttcacaacttaccgaattacagccatttttagatgccactgaccgtgcgattgtgcttatggaacagctaaaacaggatggtatcgaactgcatcaccttgatcttggcggcggcttaggggtgacttatacggatgaaacaccgccacacccaatggaatatgctgcagcgttgctccataaacttcgaacctacccaaaccttgagatcattttagagccagggagagcgattactgcaaatgcaggtattttagtcactaaagttgaatatattaaacaaaatgaagatcgacgctttgccattgtagatacagggatgaacgatatgattcgccctgcattatatgaagcgtatatgcaaattattgaagtaaaccaatcgcttgtacgtgaaaaggcaatttacgatgtcgttggaccaatttgtgaaacgtcagactttttaggtaaacagcgagaacttgcaattaccgaaggagatctgattgcaatgcgttctgccggagcttatggtgcaacaatgtcctcaacttacaattcacgtccacaagctatagaagtgatggttgatggtgataaagcttacttaattaaagctagagcaagttttgaagatttatggcgtttagagaatatagtgcctctttgtaattaatttcattcggagtatttaatgcaaaagcaaccatctatttttggcggtgcctgtatcattgcaagtgtatgtgttggcggcggaatgttaggactaccgagtgctggagcaggagcatggacagtatggactgcagttgtaatgttaattacaatgatagttatgacgatttctggtgcaatgctacttgaagcatataaaaattatgaccttcgagcctcttttaacacagttactaaagatatactgggaaataaagtaaatataattagcaacatttctatctactttgtgggaggtattttgctatatgcatatataacctctcttggatatctatttcaagatttgcttaatatcacaaatcaactatctgctattatttgcgttttagtcttcggcggattagtttggcactcaactcgagctgttgatagaatttccatcattctaattatttttatggtattgagcttcatctttagcatctggggacttgctactaatattaatttttcctatctttttgatactgtcaataaagagcaaaatgcttatgcacagtataccatgatgatgttacctatagctctgacttcttttggctaccatcattcagtctcctcaatgagggcatactacggtgaagaaaaaagagcatctaaagccataatttatggaaccatgattgctctggttttctatctaatatggattggttgcgtatttggcaaccttccaagagaaaaatttacccctgttattcgaaatgaaggaaacattgatgtactattaaatacattaggcaatgtaataaatacaccaagtataaagcaagcactcaatgcattttctatcgcagctattttatcttctttcattggggttggacttggagtttttgactttttagcagatctcttccaattcaaaaacgataaattaggtagaacaaaaagttggtttgccacatttataccgcctctcctattatctttactctttccatttggatttatcactgccatcggatatgctggagccgtggcaactatttggacatgtattattcctgcgttactaatatataaacaacgccaaaaaacaagactatatggatttaaagcttttggtggaacaccaatgatttggtttattgtcttatttggagtcttcgttgcgattttccacatcttaacaatgctaaagatgttacctatattcataggatagattatagatatggtctatagctaatttaacattcaaaataacataatgaaaaatcaaaataatttcctacagcacacgccaatgatggctcaatatctccaactcaaagcacaaaatcccgatattcttctgttctatcgtatgggcgatttttatgagttattttacgacgatgccaaaaaagcggctgcgttgttagatatttctctgactaaacgtgggcaatcagcaggtgaaccaattccaatggctggggtaccgtatcacgctgttgaaggttatttggcgaagttggtggcgttgggtgagagtgtggcgatttgtgagcaaatcggcgatcctgcaaccagtaaaggccctgttgagcgtaaagtcgtacgaattatcacacctggaacggtcagcgacgaagcgttgctaccagaacgccaagacaatttggtcgccgcaatttatcaagaaaaaggcgttttcgcccttgcgacattagatatggcttctgggcgttttttgattagcgaattacctaacaaagaggcactgtctgccgagttacaacgcacccaacctgccgagattttgtatcctgaagatttttctgatgcaggtattttacagggttacaaaggcttacgccgccgacctgtttgggaatttgagctagttacagccattcagttgcttaatcgccaatttgggacacaaaatcttacaggttttggagtagaaaaggcggtggttgccttgtgtgcggctggttgtgtcttgcattatgctcaagaaactcaacgcaccgcactgccacatatcaacagcattcatttggctcaaaatagcgatactgtcttacttgatgcggcaactcgccgaaatttggaattaaccaccaatctggcaggcggtacagaaaacacacttacatcggttttggataaatgcgtcaccccaatgggtagtcgtttactcaaacgttggatccatcaacctattcgtgatttagccaaactgcatactcgccagcaaaccattttggcattgcaaaaaaatgaacgtatcgaaccgcttcagcccctgctacaacaagtaggcgatatggaacggattttggctcgcgttggattacgcactgctcgccctcgtgacctaacccgtttgcgcacagctttagagcatatccccgatattgtaaaacattcacaacatcagaccgcttgtttagacaatactttgcagcagatcgccgattttagcgagctattcgagctattaaaccaagcaatcattgataacccaccgcaacttatccgtgacggtggcgttatcgccgaaggctacaatgctgagttggacgaatggcgaagtttggcagaaggggcaaccaaattccttgaagatttagaatcgagagaacgagccaaaacaggcattgatacccttaaaatcggcttcaatgcggtacacggctactatatccaaatcagtcaaggacaggctcacaaagctccgatccactatgtccgccgtcaaacgttaaagaatgcggaacgttacattattcctgagctgaaaacctatgaagataaggtattgaaagcgaaaggggcatctcttgcccttgaaaaacagctttatgacgaactgtttgaactgataataccacgtttgggagaattgcagttggcaagccttgtgttagcagaacttgatgtgctgaccaaccttgccgaacgtgccgaaagcctgaattatgtgatgccaagttttagccatcagcgaggtgtgaatatcaaaggcggtcgccaccccgttgtggaacaagtgctaaaaacgccgtttatcgccaaccctgtactgctcgatccacaacgccatttgttgatcgtcacaggtccgaatatgggcggtaaaagtacctatatgcgacaaattgccttgattaccttaatggcgtatatcggcagttttgtacctgccgacagtgcagaaatcggaccgattgaccgtatttttactcgtataggtgcgtctgatgatttagcttcagggcgttcaacctttatggtggaaatgaccgaaatggcgaacatcctgcaccaatccagcgaaaacagccttgttctcgttgatgaaatcgggcgaggcacatcaacctacgacggcttatcactcgcttgggcgtgtgccgaatggttagcgaagaaaacccaatcgctcaccctatttgccacccactattttgagctaaccagcttaccaaaccagcttaaaggtgttgctaatgtccatttagatgcgttggaacataacgacaccattgcctttatgcacagtgtacaagagggggcagcaagtaaaagttatggtctagccgttgccgccctagcaggcgtaccaaggcaggtgatccaactggcaaaacagaaactcacacagcttgaacaactttcgcaacaaacggcacaattagacgcaaatccacaacaagatttactcttttcagtgaatttgcaaaataataacgataacaaaccgcttgtagaaccgtccaaagtcgaactagcccttgcggaaatcgatcctgatgaactcacgccgaaacaggcgttggaggcgttgtatcggttgaagttacttataaaataaagacaccttggaatgtagacaaaattggagattataataaaaagccccatttctaactgctcaggaactataaaacagcactaagcctttttatcattgaatttactgagtttttgaatgatcacatttaaattagtatggggctttacctagaatgtgagatagatgttagataaaatgtaagtcatcttttcctcttttcacgacccttgtataatggcattgcttttttaagcaatgacaatttattttatttcagatatcacaagggtcttattatgaaaaacttcttaacttggcctgtggttgcaggtgctgcacttggtatcgttgctccacttcaatatattcgtcctgagttaatcggcttagttttaggctctttagcgatggcacttttgaccaaagaatttcgtcctcgtggcggttctgcccccattacacgcattatgctaggcttttttgctatgttaggtgctttaacctttctcggctgcccgtggcgtgcctatttacgcttaggcggaggagatttaaccagtattgctggtgtcgttgggctgcttgcgggtgtttttgcagggattttcttcttcaaacgtggattttcgctcggtaagtccggcgaacaaagtacagcatccggcatagtccctatttttattgtgatcgccctgtttattgccctgatcacccaattccgctttggtgaaaacttacctattttcttctctgaaaaagcccctgctgcccaacatgccaacctatggctttcattaggtgctggtgtgcttgtcggtatcgttatgcaacgctctcgtttttgttcaatcggtgcattccgtaattttatcttatccaaagacaactatctgctaaacgggatttgttgcattggtggtatgtacgtctataaccaacctaatgctgggtcagttcaaacttggttttgaacaacaaccaattgcctataatgatgttgtatggaacttcctgagtatgatactgtgcggcttatgtttttctctagcaggaggctgcccaggtaaacaactggtgcatttaggtgaaggtaataatgatgcggcacttttccttgtcggaatgctattaggtgcggctgcagctcataacttttcgctggcagcatcaggtacaggcatatccacctttacaccttatggggttggacttggactgcttttctgtatctatattggatttaccaataagtctactcatcagaactagggtactgtgccttattaatgaaatactgacgtacttcaggtacagtacccgattatacttaggttatattttctaacccaataattgtgagataagtcgaaagactctatactgaatcagtatagaatctttagctagcggtcatcacaaatgatagtatcgcaaaactttttaattaatgattacatagaaatttgaaccatcacgcaagatatttaaggcaatggcagatggattggaatcaagaaccttacgcaactctcctaaattctcaatggtacgacgatttacaccaacaattacatcgccttttctaaatcctcttgcctcagcaagtgaatttttttcaactttagtgatttcaacgccttttattcctttttcattatagtttgaaaactcagcaccatttaaacttggtaataaacttttcgcacttgttttggtttgttcgtcagattgtaatgtgactttaacatttttctctttaccatcgcgtaaataggttaattcaatttctttaccagctccagtagtcgctacttttgctcttagttctgcgaaactacggattttctgaccatttagccccgtaatcacatcacctgctttcaagccagctttagctgcagcagattctggtattacttcgctgacaaaagcaccttgttgtgcattaacatcaaaggctttagctaaatctgcattaagttcaccacctttaataccaagtaagccacgtttcacttccccaaattcaataatttgttgaacgagattgtttgccatattacttggaattgcaaaggcaatacctgcattaccgccacttggtgaaataatcgcagtattgataccgattaattcgccgtttaagttaattaatgggccacctgagttaccacggttcaccgcagcatcggtttgaatataactctcatacccttcgtcgatatcgcctgttgaacggcccaatgccgatacaatgccagatgtcaccgtttgacctaacccaaatgggttgccgatagccacagtgaaatcaccaacacgcaatttatctgaatctgcaattttaatttcagttaaatttttaggattttctaattggattaatgccacatcagacattgggtctgccccaactaatttggctttaaattctcgaccatcttctaatttaacggtaattttatcggcattatcaataacgtgattatttgtcactacatagcctttcttcgcatcaataattacacccgagccttcgcctttaaactgacgaggagatccgccatctctaaacatatctggaccaaagaagaactcaaattcttctggaactgcacgtcttgatgctgatgcttgagttttaccttcaatagcaatgctgactaccgcaggacgtactttttctaacattggtgcaaggcttggtaatgcttgtccgtttacagcagtaggcaatgtagcgtgagtcgccataggtgcagaaagcacacttaatccgagtactaaagaggttaaaagtgattttttcattgttactttcattgattatccttactaaatttattttacttcttatgccgaacttgatgagttcgtgttgcttttgactctgattttatttgtcagttctctgttttgtagttaattgtttaaaaatcattctttcagctaattttcggtattatgtagcacttacacaaacattcaagcttttcgtaggggcagggatacaaacgcttgtgtttgaaggttggctttgccaacggctacgaagtagcgagcgaagcgagtaaaccccactcgctattatggcgtgtatgcgtaaactgataaccattatgaatgcgttggttagacgcaatgaaaaatgggacgctacacgctacttatccacagagtctgtgggttaaagttgaataacttttttttgtgtgaacacagttgctacataatatcgctaattttaatcaatatttgaccgatataattacaaaaaatgtgaactacttcacattttatataaacaaagttttgtaggctaatttactttaaggtaacaaattaatagaatacaccgcctttttaggtttaacttatattcaactttttattcacaggatctccattatgttgtggttcttattttgcgtagccgtattaatcctaggctacttcgtttacggtaaaatcatcgaaaaaattttcgtgattaacccgaaaaaaacaacgccagcttacacaatgcaagacggtgttgactacgtgccaatgtctaaaaagcgcatttggctcattcagttattaaacattgcaggaacaggtccaatctttggtcctatccttggtgcgttatacggaccagttgcaatgctttggatcgtattaggttgtatcttcgcaggtgcagtacacgactacttctgtggtatgttaagtgtgcgtaacggcggtgcatcaatgcctaacttagctggtaaatacttaggtcgtccagttaaagcctttattaaccttttagccgttgtattacttcttctagtaggggtagtattcgtagcaagtcctgctcaattattaagtacaattactgttgacgtatttggttcagcaggtggcgcactctctttagataacgctgaagaaattgcgaaaacggcaacggcagcaagcgacattactgtatggggtatggataaaccaacggtaattgcagtttggacaaccatcattttctgttactacattcttgcaaccttacttccagttgataaaatcatcggtcgtatctacccattcttcggtgcgttattgctatttatgtcaataggtatggtgtatggtttagtcacaagtcacttcagtgcaacagaccctgtcgatttcttccgtactattgatggaatgagtgctgagaagttcttccaaaacttccaagttaaaggcgatgttccagtttggccgttactcttcttaaccatctcttgtggtgcattatcaggtttccacgcaacacaaactccattaatggctcgttgtgcagaaaacgaaagcgaaggtcgcttcattttctacggtgcaatgattgctgaaggtgttattgcgttaatctggtgtatggttggtttagcattctatgaaaacccacaagctttacaagatgcaatcgcagcaggttcaccgtctaaagtggtatatgattcttctctttacttcttaggcttcgtgggcggtatctttgcagtattaggtgtggttgtattacctatcacatctggcgatactgcattccgtgcagcacgtttaatcattgcggagttcttcaatattgaacaaagaactttagtaaaacgcttaatgatttgtcttccattatttgctatcggttttatcgtttcaaaaatcgacttcagtatcttatggcgttacttcacttgggcaaaccaaacgacagcaatggtaatgttatggacagcagcggcttacttatatcgctacaataaattctactgggtatgtacaatccctgcggcatttattagtaccgtatcatttaccttcttagcgtacaataagattggtttcggtttagattaccaattatcggtatacattggtttagcattagcagcagcgtgcttagttgcattcttcacaatgattaaacgtgaaggtcaagaagacctggatgtttatattgatgatacaactaaagcataatcattgaattgttgaactataggggcgaattttcgccccttatttttgtggatgaacacagttgctacgaaaaaattaagtgtttgtgcaaatgatatataatactggataagcacagaaatcaaagctctttttttgaaatatgaatttggacgaatggcacatctagaaaacagacttatcaacagcttactgttaaatacgagttttctcaatgttttttaatccctgtaattcgacaccattcttctttttccatgatagaatcaagtttaaagctattttggtaagcttcacaaacggattctgcttgtgtagcaagaatacctgataaacctaaattcccctgtggttttactaacgtgataatttgaggggcaagttcttttaacgggcctgcaagaatatttgctataacgacatcagcaattaggttttgcggttgatcttttgtaagaaatagttgcaatctatccgctacaccatttacttccgcattgttctgactagctaaaattgcttgtggatcaatatcgatacctattgctttttttgcacctaatttaagagctgcaattgctaaaattcccgaaccacagccaaagtcaatgaccgttttatctgttaaatccagactgtctaaccaagctagacaaagtgcagttgttgggtgtgttcctgtgccaaatgctaaaccaggatctagcattacattgactgcatttggatcgggaatttctcgccaacttgggcagatccataaacgtttaccgaattgcattgggtggaaattgtccatccattcccgttcccaatctttatcttcaatttgttctattttatatggaaagtcagtagctacaagtttactttttactaatgtagaaacaatctctttcatgtcagtttctgcatcgaataaggcaacgacatcagtattaccccaaagacgagtttctccaggaagtggctcaaaaattggcgtatcttggctgtccataaaagtcacggacactgctccaatatcttctaaaaaatcgctaattttctcagcttctctatctgtactatttaaacgaatttgtacccaagccattttgttttccttcattttttaataaaagattattatagccttgcatagcaggagcatacaagattaagtataagtcaatccaaatagaactaaataatgtatcttatttgaaaataacaagatcgaatattttggtctaaaaatgtatatttttaaaatttactccagtgatttattactaaatcaacgcatctctatacacatgaattacatatggatatcattgccaccatacgaaattgatacatctgtactggcgtattaaataaatctttcatcaaaccactccttgccatcgcaggtaatccgattgaattatatagcttttttctcttaacctattcagggcaagtttatagtaaatatctttttcggttcgcacacaataatgggaaatgacattatttgaaagcgtatccattaacactaatacgccaaaataacgtccgaaaaacgttgtatccataatgataattcaggtatcgatttgaaggcggttttaaagccgttttaggcgctttattgatatatctttgaatcgttctgactgaacaatgatatttaacggcaagttgttgataggtttgttttccggatgtgtaatcagtccaaatttttattggatctaattttgatctgcaccccaaaagttggactaaacaaccaactaattaaggtgtagatttttatggctaaatacacccaatcttttaaacaacaagtgatcgaattttatcttcaacataataaaaatcgctcattaactcgtcagcattttcaggttaaggaaaccatattgagatattggattaatcagtataatcacaatggtatcaatggactagctgtttgccacagcaaacgagtttactcatctgagtttaagttatctgtaatacaagcggttaaacaaggtcaattttctactctgcaagcggcattacattttggtattcctaattgctgtgtcatcagccagtggttgcaagcctcgtgaaagaactgcgccaccaatttccgtttgagattttattgcaattggttgatttaaaacggagtacgttcttttatcatcttgctgaaaaagacaataaaaatgcagcgattgagcaagaagttatcaaaatttatcacaaaaatgacggtaattacggttatcgccgtattacgctggaattaagaaaaatatagctgattaaccataaaaaagtccaacgcttactgcaacagcttgggttgaaagggaaaaacaaacgcaaaaaatatcattcttatcgtggtgaagtcggcaaaattgcagagaatttgctaaaacagaattttcacactacagccccaaatcaaaaatgcgtcaccgatgtgagtgaatttaagtgtgcagaaggtaaactttatctctcgccgattaaggacttgtttaacggtgaaattattgcttatgatgtggcaagaaatccaagtttcgagcagataagccgaataatgaaacaagctgtggcaaggcttgacggagcaacgccgatactctattctgaccaaggttggcaatatcaaatggcaagttatcagtcgattttgaaacaaaacggcatcgtacaaagtatgtcgagaaagggaaattgtttggataacagtgcaatggaaagtttctttgggcgtttaaaaacggaatgttactttggtaaacggtttgagacctttgagcaactggaacaagctattcacgaatatattcattattacaatcatgagcgtattcaagtaagattaaaaggactaagccctgtggaatacagaactcagtccttgaactaaatcagtctaactttttggggtcagatcatagctactcgcaattttatagccgagctgcttatgacggctctcgcgaaatcagtttttatcttgataaagctgttcatggcaaaggtatcggtaaagcctctgtgaatttcttaattgaacaaatgcccaattaccaactgcatacattattagcttttgtgttcggcaataacgatcaaagtttaggcttactgaataaaatgggctttgaaatttggggaaaacttccccaagttgcagatatggaaacagattttgaagatttagtaaccttaggattgaaacaaggcgtatgtggcagttaaaagcattttccgagctttctactcaagaactttttgagatttaccaaacgcgtatcgccgtttttgtggtagagcaaaattgtgcttatcaagaggtcgatgaaaaagatctgaaagccttgcacctttttgcaaaaaattcgcaaaaactgaccgcttactgtcggattattcccgagcaagatggtgtacatatcggtagagtgttggttaccaaagaaatgcgcggaacaggtttagcgaaaaaattgatgacacaagcactcactgtttgccagcaacaatggcaaagtgaaaaggtctatgtgcaagcccaagcctatttgcaagatttttaccaatcgcttggatttaaaccgatttccgaagtttatttggaagatggaatagcgcatttggatatggtgaagggtgagtaatatgatgaaattgaccgccttgctaggagaataacaatgacgaaagacgaaattctgcaaaaacaaaaagagcttgatgttttgttctctgcttggatagcggaaaagaaaaagaaggaagttttgacttatcgccgagaaaatggggatttgattgagcatcacccaaatggttttattcgagtgattgaatatgcacaataagtctcttgctattttctactgcggaacaaatggagcgggtaaatcaacattacgctcttttaatcaggattccgtgcagattgtgattgattcagatcatattgcaatgcaaattaatcctgacaatccaagattggcagatattgaggcaggtagaaaagcaatagagctatttaaatttgcaatacgacataatatttctttttcaatggaatcaaccctatcgggtacatctattttgcaaagaatggaagtagcgaagaaaaatttttatactcgtttaaattatgtcggggtggatgatccaaaaataaatattgctcgtgtcaaagcaagagtaaaagcaggcgggcattttattgatgaagagacgattaaaaggcgttatcaaattagtcgagaaaatttaattcaagcaattttattaaatgatgaaacatttatttacgataattcatcagatagccctaaaatacagcttgttatttcagcaaataaaactgttactaaattagcagataaattgcctcaatggtgtgaggatttagtgaacgagttgttaatattggggtatgcaaaataaagttggtcagtaaaatttgccttatccctagcacggcaaagccttgactcagttacgcataattcagccctgctggggctggggctgaggattggaaaaagcgccacaaagtggctcactcagctgaaggctgatcgtaaccacgtacggcttgccttgcgtgggaaaagagcggtcgaatttttgtgaaaatttgcaaatgaaacgatagtgctgaactctgctgtatacaaataggcattcaacaaacttgagaattatctaggagaaaaggaaatggcaagtataaaagatgaatttggatgggcaataccattaactaaagaagaaataaatgatatatggagtaaagcaatattaactgtagacacaaatgtattacttgacttatatagatatcatcctaaaacaagaaatagtatattaaatagttttagaatgtttgaaaatcgtttatggctatctcatcaggttgttaaagagtttttcaaaaatagaactactgttatttcagacgctagaaaagattttgataatggaaaaaatattattaatgctcttccagtaagtcttaataaacatattgatgaattaattaaatcaaacagaacggtttctaaagatctaatagataaaataaaaaataaactatcagaaacaattaatgagatagttaaaaatgaaaatgatgaatcggaaaaggtatcatatttgaatgatgaaattataaataaaattcttcaatattttgagaataatattggggataaatttagagaggaggaattagaaaaaatattaaaaatggcagaagatagatttgcaaaaaaaaattccaccaggatataaggatgaaaatacaaaacaaggcaattctaaatatggggatttttttgtttgggaacagattcttagacatggtgaattaacaaaacgtcctattatactgattacatcagaacggaaagaagattggtgggagataaaatctggagaaacgataggcttacgttctgaattaaagcaagaagcttgggatcgcttgcagcaacatattttggtttatcaaacagaaaatttcttatctatcgtggcagaaaaggaatctgagacaaagatagtagaggaaattaatgatgcaattaaggaagtgaaacaacttaatgttgaaaaagaaattattggtttacgaaaatttacaaagtcacaaatagtaaacaaagtagaacaatctatagagtttaatactgaatatactaatatcggctatattagttgttatattgggtatccaacgaaatattttacggtaagtggtcaactagaacctagattaaaaaatattcctactttacatgtagaattgttagatagccccaaagaatattttgttgagccacatgctagtacaggaacaaaacatgatttcaatatccatatgaaatcaagagatattgtgtttgatattggaacttatgtattcaaatatcatgcatatgtagaaaaagaagacttaggaagtcattattatgaagaactggttgttccttgccctagttgtggaggggactatcttttagatataaatcagtgctgtgaatgtgagtacgaaagtataagagaatgccaattatgtcataacgaaataaatggacatgaattagattttgcaccatattgtagttattgcacatataaaatgaataaaaatgattaattaacttttaaaatattagagtattaacaatgaaccagaatatccatctccaaatggcagaccgctttgattcttcagcggtcgaacaagcactttataaacactgggaagaacaaggctattttaagccgaatgaaaacccgaatgttccaagttactgtatcgcaattccgccgccaaatgtgactgggagtttgcatatggggcacgctttccagcaaaccttaatggataccttaatccgttttaaccgtatggaaggtaataacaccctatggcaagcggggactgaccacgcggggattgcgacccaaatggtggtggaacgtaaaattgcagcggaagaaggcaaaactcgtcacgattacgggcgtgaggctttcatcaataaaatctgggattggaaagcttattcaggcggtacaatcagccagcaaatgcgccgcttaggtaactcaatcgattgggatcgtgagcgtttcacaatggacgaaggcttgtccaatgcggtaaaagaagtgttcgtgcgtttacacgaagaaggtttgatttatcgtggtaaacgcttagtaaactgggatccgaaattgcatacggcgatttccgatcttgaagtggaaaataaagagagcaaaggctcgctgtggcatttccgctatccgttagccaacggtgcgaaaacagcggacggtaaagattatttggtggtagcgaccacgcgtcctgaaacgatgttaggcgatacggcggtggcggttcaccctgaagatgagcgttaccagtctttgatcggcaaaaccgtgatcctaccgcttgcaaaccgtgaaatcccgattattgcagacgattatgtagatcgtgagttcggtacaggtgtagtgaaaattacccctgcccacgacttcaacgactacgaagtcggcaaacgccatcagttgccaatggtaaacgtgatgaccttgaacgcggacattcgtgccgaagcggaaattatcggctcagacggtaaaccattgcaaaattatgtcgcaattatcccggctgattatcaaggtttagagcgttttgccgctcgtaagaaaatcgtggcggactttgaagcccttggcttgttagacgaaatcaaaccgcacgacttgaaagtgccttacggtgaccgtggcggtgtgccgattgaaccgatgctgaccgaccaatggtatgtgagcgtgaaaccgcttgcggaagtggcaactaaagcggtagaagacggcgaaattcaattcgtgccgaaacagtatgaaaatctctatttctcttggatgcgtgatattcaagactggtgtatttctcgccaattatggtggggacaccgtatccctgcgtggtacgatgcggaaggcaacgtttatgtagcgcgcgatgaagcggaagtgcggtcaaaatatcagttaaatgctgatgttgcgttaaaacaagatgaagacgtgttagatacttggttctcatcaggcttatggacattctcaactttaggctggccagagcaaaccaaagaactcaaaatgtatcacccaaccgatgtgttaatcacaggctttgacatcatcttcttctgggtggctcgtatgattatgtttacgatgcacttcatcaaagatgaaaacggcaaaccgcaagtgccattcaaaactgtgtatgtaacgggcctgatccgtgatgaacaagggcaaaaaatgtcgaaatcaaaagggaacgtattagacccgattgatatgattgacggtatcagccttgaagacctgcttgaaaaacgtacgggcaatatgatgcaaccgcagttggcggaaaaaattgctaaagcaacccgtaaagagttcgagaacggtatcgccccacacggtacggacgcactgcgttttaccttggcggcattagcgagcaacgggcgtgacatcaactgggatatgaaacgtttagaaggctaccgcaatttctgtaacaaattatggaatgcgagccgtttcgtattgaccaacgataaattagatttatcggcaggcgaagtggaatacagcttggcggatcgttggatccaatctacattcaaccgcaccgtaggcgagttccgtgatgccttaagccaataccgtttcgacttagcggcaaataccatttatgagttcacttggaaccaattctgtgactggtacttagaactcaccaaacctgtgtttgctaacggtactgacgcacaaaaacgtggtgcaagccaaaccctcgtgcgtgtgttggaaaaattattacgtttagcacatccgatcattccgttcatcacggaagaaatctggcagaaagtgaagggctttgcaggggtagaaggcgacaccattatgttacaacctttcccgaaagtggaagaaaaccaaattgacgaagcggcggaaatgcaaatcaactggttgaaagatttgattgtggcagtacgtaacattcgtgccgaatgtaacatcgccccaagcaaaggcttggatttcttagtgcgtaacctatctgacgaacattgcaaaatgttagcggaaaacgaccgcttgttaaaagcaatggcgaagttagacagcgtacaagtgcttgctcaaggcgcagaagcaccactttctgtggcgaaattggtgggtaatgcggaagtgttagtaccaatggcaggctttatcaacaaagatgccgagcttgctcgtttaaccaaagagatcgaaaaacttcaaggcgaagttaaacgtatcgaaggcaaactcagcaacgaagcctttgtggcaaaagccccagaacaagtgatcgctaaagagcgtgaaaaaatgcaggagtaccaagacggacttgagaaattgcaagcgcagtataaggcgattgaggcgttgtaatatagtaataactgtccgttggaggtgatattctccaacggctctattagtcacgaaaacacatttcattatgcacaatacagtttataaatggcctgagccgtctcatctctatccagatagaggaaaaaaatcttatagattaaaacgtttccgttatcgttttcgctctatattacatagatctctcataaagaaatttgaacataaaattaattctgaatcttcgttaaaaccgttattaatcaaaagagccgattatagctatcctttagttcatcgtttcttagataaacgctttaatagtcaaagacgttttaacatgatttgtgacaatttagactttttacctaaagtactcttatctaaaaatctccctcagttatgggatagccctatatgttttacagaagtaattgaagattttgaaatctatttaaatgtcaacgaatatcaaccaatggagggtttctgggcattagaattacgctataaaccaagcggtcaattagtttatttattgacatttggtaaattagaaaatgcattacttatcgcagttattcaaggtccgaactttgaaggttctaaagaattagtcaaacaactaactaaaaaatgccatgggcttcgtccagcctatttaatggttgaagccatgaaagctttaactcaggtcttagggtattctaaattatttggcattccacaaaaatatcagaataagtcacgctttgttcaaagcacacgctattttgttgattatgatactatttttaaagagagtaatggtgaattaaaggaatattgggaacttcccttaacattagagtcaaaaaaccttgaagatattccgagtaataaacgctcaatgtatagaaaaagatacacaatgcttaatcatttattaagggctattgcttctaaactaaaatctgagttagatgtagtcgtttagataaattaggtacttaatttttagggggcatagtagacaaaatagttgctaatttcgtgaaaactacgcctatatgacaaagtggttgctaatgaatattttaattattcttagcaactctttttatttaaaaaatcctttataaacataatcttatgtcttttcattaatcctgtatgatgcgataatttttcctttagttgcccaaataagttttcaagtctatttgtcgttttttcgatatttaaatcgccatgcttttcataggtaaatagataatccatataacgtttaaaactatgataagcacttcttacattccgatgtttataaggataatagcccttttcattcggtttctgaccgttcttctaaaaacgctttatgttttaaataccaatgatgtaatcgtaaatagacgtcttttttagaactctgtttaagcgttaatgctattgtttttaattcttttccagctatagattgatgcttttttcgtaatgctctcatcacaatagctaccatatgaaaatggcacatttgcgtcggtgtatccaataaatctttcaatataccccgtatgccgtcgcaggtaattgattgaatgttatagcctttcatacgaagtgaattaaatgctattctgtaatacacatctttttccgttttgatggcacgatggtaaaccacttttttagaaagcgaatccatcagggctaaaataccaaattcacgaccaaagaaggtggtatccgcaataatatttaaatcacgtgatagtggtggatttaatttctttttaagggtaaatgttttattacaagcattacatttatagcgttgaatattatttcttataccatgtttgcgaatgtcgctactgtggcaaaaatgacattttttgggttcataattcaaaaaagtggcttaaagcctgtaatataaggttaagccactttttagtaaccagtttgtctactatgccacacttttgtctactatgccattgcaaatagccacaaggtttgcaccagtcccatacaacaagtagcttggcacaatatgcaaccgttcatctttttctacaatattatttccttaatttcgcatcaagagataatttacctgcaccactatgccacaataataagaatgccatactaaataatgcagcagcttcgcctttgttactaattggatcgaaaatcgcccctgaagcagcgtggaacataaaataggctactgccatttgtcctgctaaaataaatgctgttgcacgggtaaataaacctaaaatcaacaagataccgccaacaatctctaatacacctgctacaccaaacagagaaaagagtggtaccgcaccattgccgcctgtcattgaaatcggtaactcaaagaattttgcggtgccatgaagtaaaaacatataaccgactaatacacgagtgattaataggatatatggactgaaagtttgtgctaatttttcaaagaagttgttcattatgttttcctctaataaagtaaaaatatgttaatcgtcaaactgattaaatgaagtcggtcattatattgaaataaagcattagaaaaatagtgttttttgaattatagtgtttcttattaagaaacaaacagggaaaaatatggacaaactaaccgccattaaggtctttctgaccgttgccgaaacaggcagttttaccgccactgcagaactcttagagatttccaaaccgatgattagccgttatgtcgctttaaaggaagaatggctgaacgcccgactgtttcagcgttccacccgcaaagttgctctaacagatacaggcgaacaagcggtgcttttttgtcaaaaaattgctaatttaaccgcagagatggaacaagaaatgatggcacagcagggtgaattacatggtttattacgtattaccagtagccaaagttttggggcatatcatttggtacaaacggtcaatcgatttttgcagttgcacccgaaattgaatattcagttgttgctcaatgatcaacaaatggatttaataagcgaacggatcgaccttgccattcggattaccaacacgcccgacccgaattttattgcccgaaaacttgctgattgccattcattgttggtggcaacgcctgaatatttgacaaagttcggtacgccaacgcagcctgaagatttgtatcaacatcactatttgtcgcaccataacatcaacgcgcaaagcgtggaaatgtatgcaaggggaacaggaagcgttgctcgacctaaacagccgttccaccaccaacgacacccaaactttacttaactcagtactggatggttacggtatttcgatgttaccaaaatatatgctagaaccagaacttcaacagggcaaattgcaagccgttttaacagactggcaattaccgaaattcagcatttatgcaatgtatccttcaagggacaaactcccccttgccgtaagaaaattgattgattttttggtggagagttttgaagggaaagcatagtaagcaaaaattaaaagccgcataaagcatgaactttaagcggcttttaatctatctataagaaattatagtgaagcttgatcaactgcaacaccagcacccatagtggtagagatgcttactttcttaataaagatccctttcgctgttgtcggtttagctttcactaatgccgctaataacgcttgaaggttctcttttaattgctctggagagaagtctgctttaccgattgtagtatggataataccatttttgtcgttacggtaacggatctgaccagatttagcatttttaactgcttctgctacgtttggagttactgtaccaactttcgggtttggcattaagccgcgtggacctaatacttgacctaattgacctacaacacgcattgcatctggagaagcgataacaacatcaaagttcatttcgcctttcttcacttgctctgcaagatcttccatacccactaagtctgcacccgctgcttttgctgcttctgcgtttgcaccttgagtaaatactgctacgcgagctgtacgacctgtaccgtgtggtaatactgttgcaccacgcacgttttggtctgatttacgagggtcgatacctaagtttaccgcaacatccacgctctcaacgaatttagctgtcgcgaattgttttaatactgcgattgcttcattgatgtcataagctttagtagaatctacaccagctttaattgctttcatttttttagtcaatttagccattgtattattcctctacgattaagcccattgagcgagctgtaccagcgattgatttcattttggtttcgatagtagcaccagtcatatctgctgctttagtttcagcgatttgacgtaattgtgcttgagttactgtacccactttatctttgtttggtttgcttgaaccagattttaagccaagtgcttttttcaataacactgcagctggtggagttttagttacgaaagtgaatgaacggtctgcgtaaactgtgataacaaccggaattggtaaacctttttctaagctctcagtacgagcgttgaatgctttacagaattccatgatgttaacaccttgttgacctaatgctggaccaactggtggtgatgggttagccatacccgctgcaacttgcagtttaacgtaggcttggactttttttgccatttttaaagtttcctcttgtgtgggtgataacgccgaaaacggctccccttgtttttaataaatgaaagcactaaaagcactaaattaggtttatacagctaactaaaaagtgcacctccattattgaataaatttcattatttatcaagtaaatttatagtagactttgatttgtattgacatacaatacccatgatgaaatggacttgttacttttatttcaatctggttatttaagtgaccattgctcaaaaggtataccgataagaaatagcatttcagctaaaaacatacaggatggaatctaaagcactcgacgagattgagtatagcttttagcccaatatctctctgacatagaacttgtagttacaccttggcttgagctggcgtgaacaaatttgccattaccgatataaacaccaacgtgattatttttacggaaaaagactaaatcacctggacgtaattctgatttagagatggatttacccatatgtcgttgttctgctgttgaacgaggaaaatgttggctaaaggcagaatccataatggcttgcacaaaagcagaacaatcaatacctgctttgctttcaccgcctagacggtagcgagttccagcccattgacgatagacattcattactttctgtgtcacatcttgtttttttgctgaggcaaattttgccgttgtttttgctttatttaactgcgttggggttgcaggtttggtactcaaacttgcgacagcgtttgaactatacccaatagacaacgcaatggtcagagaaaaaagaacggttttggttaaagaaaataatgatttttgcataataaatttgtctcgccagaactagaaaagcgaattacctcaactaaaaattacaagaatttgtataaaataaaggttttgttccgcacaaaacccaccacgtcagaccagtataacttaattttgttccaaagaacgtagaaaatttatctcatcagcccaaatttcaggttcgattgtttctaaaatgagcggaatgttgtcaaaatgagcattattcataataaatttaaagacatctgtcccgattgtgccttctcttaatgtgtgatgacgatctactctgcttgcaagcggtgttttggagccatttaagtgcatacctcgcaaaaactcaaaaccgaccactttatcgaaatcagcaaaggtttgttcgcaagaagttaatgaactaatatcgtaacctgccgaaaataagtgacaagtgtctaagcaaacgccgacacgctgtttattttcaacttgctcaatgatttcagctaaatgttcaaatcgccaccccaaatttgagccttgcccagccgtgttttcaatcacagccaccacattaggcacactatcaactgcaatgttaatcgattcggcaatacgcgctaaacaatcctgttccgatattttatttagatgactacctgggtggaaatttaacaaggttagccctaattgatcgcaacgtcgcatttcatcaataaaggcttcgcgtgattttgccaaattttccgcttcgggattgcctaaattaatcaaatagctatcgtgaggaagaatttgtgctggcgaaaaatggtgaacttggcaaaaacgtttaaatttttcaatagtatcctcttttaagggcggtgcttgccattgacgttgatttttcgtaaacaaagcaaaggcattcgctccaatttcgactgatcgtaatacagcattctcaacaccaccagaagcactaacgtgagcaccaatatatttcatcttattttctccaaataattcgtgtaacataccgctttcatttttacggaaactgattttatgaaccaaacaacgatcaacgacttttctctactgtgccgtttgttcggcaatctcttttatcgcaacccaacagatcctattttagcagggacttttgcgtggctaaaacagggttatcttcgtcaaacttgggcattggcaactgatgaacagagtgaacttgccctaacaatcatagaaaaaagtgctaaccctacggaacaagcggacagttatcaagcactttttgcggaaaatggagctattgctacaacaatctctgcctatggattatctgttgctgactttgtggctttccgccagcaaagaggtatgcctgaattagcaaatcccgatcacgttgcattgttactgctaacagcctcttggattgaagataaccttgattctactgaggctcaacgtgatttctttgaacattttgttttaccttgtttaagcaagttcttaggcaaagtggaagcctttgatacaggtttttataaagcattagcccaacttactcgagatgcattaagtgcaatggcggatgagttggaagagttagagaatatgtagttttgttggtattatcatgtagctgttagatagtacagaaattacttttgctaacagctacatggtattaatttattcaaggaatgtcagtgcttgcttgacaacttctattttaaacgtgccgaacccttggctttcaaactaccaagcataccaactattcaatgggtaggtatcaatagctacggttcttgggactgcgccagccctcgtcaaattcctgtttggaaagataaagggcaacgctattgtacaggtggtggttctgtggttgaagcaaaaccaagtgtatgggacgcattgtcgctaggtaaagacgctcctcaagcccagccaaatagagccgatgaagcagaaggacaagctccgattgaggaagtggctccgacggaataaaattggtatttcactactcctttttgccccccctattctcccaaaacacactaaataaaagtgttcataagcaagtataattttactgttataccacaacttatgaacactttacgacactattatttttcaaaatgagatactaattcccactatttaatgaataatttcacttaactcaacccgacgtttttcccttacagaaatcgtacaggcgtctgcggttgcaattgcagctcttgcggcttcacctgtgagtagttttataaactcttcatttggttgcataccgtgtaaaatatcattcagatatttcatctcttttttcataatagaacttagccacgaacagtattatcaagcctatctgtcgatgaatactatttcacgcagagggctatttcgcagtttgcttggcggtacgcaaaaaagtgtgagtacggaaatcgctcgccaagttgcccgcccgccgttttcttgccccgaacatctgtttgtatcggtatgcaacggttgtggagagtgcaaaattgcctgttttgtaggagtcttgggattggaaatgtacaagcggtaagagcagttgctaaatttgcaataaatcttaccgcttgaacttatctagtgtaacgctttcagcgtagtaactaactgttgataacgctgatatttttgttgataggcttcaaaatgttcaggatttggttgcacttgacgcattgcttgttgcaatagttctgggggattttcgccagccgcttccattgccatcatcgctgtccctaagcaacctgtttcttcaatatttggtacttctaagatcattcctgttaaatccgccagcatttgtaaccaaattggcgacttcgtcggtccgcctgtaatccgtaatatctgagtattcgggaaacgttgtagcattcggttgagatgatgcattaagctgaacagtacgccttcgtaaatggcttggagtagatgagcttgtgtatgatgtgcttgtattccataaaaacctgcttgcatacctaaacctgcgttagagccataaaggaatgggacaaacagtacagagctagtcgcaggcggtagttcagcaatcgtttgattaatgtgagcgtaatctaaattccactgtttgataaaccattctaaattacccgctgaagttgggctggcttcgtggacgataaatttgcccgcttgtgcataacgtccgtaaacaaacggtaaatcttggtttggatcgatatggtctgtgataccactgacaaccgaccaagtaccgagtacggcattaagtttggtttcatcatctaaccctgcacataatgcggtagagacgacatcgaataagccgccgaccacaggtgttcccaccgctaaaccacaaagagcggaagccttttcggtcacataacctgccacttggtttggggcgatcacaagcggcaatttatcaatgatttcttgcaaaccaagtatttcagcaagttggagatcgtattttccttctgccatattgtagagattggactcagaaatattggtttcttcacaatgtaattcaccagtaaggcaaaagcgtaagtagtcgtgtgacattaatacagaaccgatttgtgcataacgttctggttcgtgttcttttatccagcgtaaaatggaaacggggtgccctgtccataaggtttggcgggtgattgggtagagtttttctggtatgccttctttttgccactgtttaacgatgtcgatagaacgttggtcggaagataagatcgctctacctagtggttgtttatttttatccagtaaaaacgcaccttttccttgagctgaaatgcctactcctttgattgcggttggctctacatcacttttttcaagtgtttggtgaataacattggcacagacttgccaaagttgagccatatccctttctgcataacctgctttttcgctgatgaccgctacattttcacgagcaagtccgcagatttgtccgtgacgatcaaacagtgctgctttaataaaagtgccaccacaatcaatgcctaagtagtagttcatttgagttcctttttatttctgtattagcaaatcccccttttgggaaaaagggggatagagaagatttattatttcgctaacccatcaattttttcaactaattcactgccgtttttctcaataaaggctttgcgaacatctgcttcaatgatggctttaaacggtttgttatctacttcttcaatcacttgaatacctgctttttgtaatttagcgatgatctctttttcattctctaaattaagctggcgttgatagttgcctgcttctttagctgcatcaagaattgcttgttgtaattctggtgagaaactgtcgaatttcgctttgttcattacaacaattaatggagtataaccgtgattggttaaacttaaatgtttttgtacttcataaagtttagctgaccagaaaataccgattgggtgttcttgtgcatctactgctcgtgtttcaagagcggtataaagttcagagagtggcattggcacaggatttgcaccaagtaggctaaatgcctgaatatacattgggttttggttagtacggacttttaaccccttgatatcttcaggtgatttaactgggtgttttgagttagtaaatgagcggaacccgacttcccagaaagctaagccttttaatccttgtgcttctaaatcttttaataaaccttgaccgatttcgccgtctaatacagcataagcgtgttcacggtttttaaagataaaaggaatatcgattacatttaattttggctctagacctgagaaatttggtgagccagacatttcaatgtcgatagttccgccacgcactgcaccgatcattgtttgtgcatttcctaaggtgctatcagggaataagctcaatttgatttcacccttacttttttctttcagtaagtcattaaatttttttgctgcggtatgttgggtatcgctacgaggtgcttcgtaaccaaaacgtaaggtggtttcagcgttcgccgttccactaaacaaggcagcagaagcgattaaggcagcgagtgttttaagattaaacagtttcatagtgttctccttgtaaaattaaggttgcatccacgaaagtggcgttaaaattaatgatgggaagaagacaaaggtaaatagcaatgccaccatcatcaacatatatggcagaatacctttagcggcttgatcaaacggtagtttggaaactccagtaattacgttcagcacgttaccgacaggtggagtaattaagccaatagaggtatttaagataaacagtacgccgaaataaacagggtcaatacctgcttcttcaataagtggcattaatactggtgtgagaattaaaaccgtaggtgttaagtccattaccattccgatgatgaatacggcaatcataatcacgataagtaatagagttggagaaccgatgagcggttcaagtaattctgtcatcatttgtggtaattctgctacggtaattaaccagcccgtgacatttgctgctgcaacaaggaacattacaacagcggttgtttttcctgcattgagtaggactttatacagatcttttagcttgagttcacgataaacaaagagcgatacgaccaacgcatagaacgtcgcaactgcccccgcttcggttggtgtgaacattccagaacggaaaccaccgatgataatcacgggcagcatcaacgcccagatactatttttaaaggaaatacaaagctcttgtttcgtcgcttttgagaatgtcattaaattaagacgttttgcctgccaccaccaaagtgccgctaaacaaactcccatcataataccagggaaaatgcctgctaagaataatttggtaatagatacaccgctggcaacaccgaagacaataaacggaatagaaggtggaatgatcggagctataattcctgcggtgccgattaaacctgcggatttatccaccggatagcccgtcgttttcatcatcggtaacaacatggcagcgacagcggctgtatcggctacggcagaaccggaaaggctcgccataatcattgccgctaaaattgccacaaaacctaatccaccacgtttatgtccgactaatttcatcggcagatcaataattcgtttggatagtcccccctcattcattatttcacctgcaagaatgaagaacggaatagccattaatgaaaagctatctgcaccactgacaatttgttgagcaagaatttgtgcatcaaacagatcaagatgtaacattaatgcgatgccacaaactaagagagcaaaggcaacaggtatgcctaaaataattgcacctaatagtacagaaaggaaaattaccaccgtcatttggtttctcctctaataagtattgctgctgttgatatcactcttgtggcaattaatattgcaataaacactcctgaaataaccgctgcaagatacgttactcccgttggtatttcagatataggcgataagttatgaagatttaattggaattgaacccagccaccttgcacaacgagatagcagcaaaataacataatgctatctgtaaatagacgaaggatatggcgtgtggtaggggaaagtttgtcggtaagcatagtgacactaacatgttgattatcgctaaaagcaagaattgctcctaagaatgtcagccacacaaacaaataacgggaaacttcttcggttatgttaatactgctattaaatccataacgcagaacaacatttaaaaagaccaaacaagccatcgtagataagatgatcaccacaagaaactcaagggctttgctcgtataaagtgctagagatttcatattacacctcaatttcgctcattgcgattttgacgacgattttgcggatcatttccgtgccgtcgtaaatggcagtacggtgggtatcttcaggaaaaaagactgcgaaattcccttcaacacagtgaaattcattttcttgctcaacggctgagtagtattgaatatctcgctctggatcataggctgttgcaacagggttttgccctaaatcaatcgcacttgccattatttcctttccccgatgtaaatattgtacgtctaagtaatttcggtgaacttctggctggtaagcagatttaggtttagtatctaaatcaagaacttgtacataaatacgatcttctttcagtgaataacgccctacttcaaggcgatcaaagtcggtattttgtaagtaatctagagcaaattgaattgctttcggatattggcttttgtttacgttggaaatgtgaccgaagaacatttcatcctccttttagtaaaaaagatggaaaattggatcgctatatgtttatagcgacttcaatttcgcccaaacggtatcatctacaggaataccattcgctttgttctctgccagaatagtggtaaattcgtgtcctggtaagcgaattgccacatttggatcagaacgttccgctgtgcggacataatccataatccgttcaagtttttcttctttggttttgccatcaattaagcgatcaacttcgattgcaataaagatttgtgaaacacaatattcatcatctttatcttctgtcaccgcagcagtcgatagaccattagaaagtaaggtagcaatcatatctaacacgatagataaaccagaacctttccagaaacctgcaggtaataagcgacggtttttctcaacggtacccggatcacgagtgagattgccgtcatcatcaaaaccagcatcaacaaaggtttggcgccccgctaaacgatgaacttccaacatgccgtaagagtacattgagcaagacatatcaaccattgtgattgggttacttggtacagcaataattaatggatttgttccgatacggcactcttttgccccccaaggtggcattaccgcaagggcgtttgtccaacaaatgccgatataacctttctcagcagcttgccagccataaccgccgccacgcatccagtgatttgcattttttaatgccactacaccgataccaaattggtcagcaatttccattgctctatccatcatttttttagcagttaagttaccgatggcttgatgtgcatcccattgttcaatcgcacctaacgaaagcactttagttggtacggcatcaggaatgatatcgcccttttctaattgttgaataaagcgcggaaaacggtttacaccgtgagaataaacacccgcttgggtagtgtcagcaaacattgtggcacactcttctgcaatctcttcacgaacattgcgggcaagtagcacacgtttaaattcggctttaagctcttgatatgatactttcattagtaacccctttgtttcatatatcaaaatgatatttcataaattaaacttaaacagattaaaagtcaatcaaaccataaaaataaaaaccatttaaaatcaatgtgttatttgtaaatttttagttttgtgagcaagatctcatttttatgggattgcattccaaaatatgaaacagaaaaatatgctatgataggaggtataaaatgaaataggagaacagaatggcagaggaaaaaagtggtggaaatcaaagccttattcgtggtttacgtttaatggatattttaagtaactttccaaatggttgcccactagcgaaattggctgaaatttcagaacttaacaaaagtaccgtacaccgtttactgcaagggttacaaaacgaggggtatgtgaaagcagcaagttctgttggtagctatcgtttaacaacaaaatgtctaagtttagggcagaaaacccttgcttcaatgaatattattcatttagcttcctcgcatttagaacgattaaatcttgccttaggtgaaaccgtcaatttttcaaagcgagaagacgatcacgcgattatgatttacaagctcgagccaacattgggtatgatgaaaacgcgtgcctatattgggcaacatttgccactttattgttctgcaatgggtaaactttatcttgcttatgaagaaaataaagaatatttagatcgttattggcaggcacatagcggtcagattgagcaaagaacttgcaaaaccattacggacattcaagctatgcgtcaagaactcaatgacattcttcaatctggttttgctatggatagggaagaaaatgaacttggcgtgtgctgcctcgctgtacctgtatttaatcaccttggcagagtggaatatgccatttcagtttcaacatctattcatcgtttgaatgaatatacgatgggtgattttctacgcgaggtacaacaaactgcacaagctatttcgcaggagttagggtggaaggaaatttaatcttaccaatgacttactatgtctaatctaaagtaatttagaatataaagtatagattggtggctaaggagatgatttactataagcagtaaactattatttatggttatatgctaatatagatatctagcatagtagacaaaatagttgctaatgtttattttctttaaatattagcaactctttttatttaaaaaattatttataaacaacgtgttatagatttcgttaaccccttgtaattatttaatttccactcaagttttctaaataatccctctaagtgatctatagtcttttctatatttaattcagaatatttctcataggtaaaaataaaatctatataacgatttaaactggtataagtacttcttacattacgatatttataaggaatgttgataggtttgttttccagatgtgtaatcagtccaaatttttattggatctaatttattcttaagggaaaatgttttatgacacttatgacaaaaatatcgttgaatattatttgatatcctatgtttttttattttcaggctttggcaaaatgggcagttttttgttcatgtttcaaaaagagggcttaaagccttgtactatcgatattatgtagcagttgctacataaattttcctactatgtcgtttattagctccaatacgttacccttccaaaacacccaccacaaactccgcaatctgctccacattattaatatccaacagattttctctttccaacggataatccgttgcggtggcaagggtgaagagatctaactcaggtaagggtttatccatctcttttcggtgtagctgaattttcggcaaggtttcgtgtttgaagccttcgactaaaatcagatcgacattttgtgtttccatctgttttaccagtacattaaaagacgcgagagtattcgtttccaccatcatcgcccaacgctgttcacacacaatcattgtcggatttgcccctgctaaacgtaggcgatggctgtcttttcctgctttatcgacatcgacattatgatgagagtgcttaattaaacctacttttatccctttttgatttaactggggaatgagcttttcaagtaaagtggttttgcctgtgccactataacctgtcactgcaagcaacggaacgcccccctctgtcctgcggacatctcccccgcaagcggagggagggaatacggaagaaaatcttctggggtattaaaattgttaaacgcctgtttttgttcggaaaaatcaacggcaatactgcgttggctttggaaaaactgaaatagacggcgttcgccattattcaggtaatcttgtaatgcaggtacgacagaacgatggattaaagcaaaagtcgggtgtgggcgttcaccgtcgtgggcaaaggcaatttgagcattgttgatctgtaaggctgtacttagttttacggcaagattttcaggtaaaaatgggctatcgcaagggacaaatagcaaatattcactatcaatttgctcaaagccagctaacataccgcttaatgccccttgaaagccttcaagacaatcggcataaagcggaatatcaggatagtgttgctgatactgcgcttgcaagcggttcacattcaaccagattttgcaaatttgtggggataatctttccaaaatatgagaaatcagaggtttaccttgtagaagttgcaatcctttttgtaccccattcaaacgacgagcaagcccccccgctaaaattaccccttgaatttgattaaattgcatttattttccccttgtttttgcaaaattaaccttaaaagtatatgatcctgcctagttttttccaaattttttaaggattttctgatgaaatgtaaacgtttagacgaagtgttagagctattaggtgaacattggcgtaaagaacccgatcttcacttacttgatttattacacaaacttgctgaagaagttggcaaaccgaatgatttagatgcactgcgtgatgaagtgttaatttatcaactcaaaatgcgtgaaaaagataaaaccgaagtgatccctggtatcaaaaaagattacgaagaagattttaaaaccgctttattaaaagcgcgtggaattttaaatgattaatgttgtcataggatcgacttttttaactcgaggaatttatgaagaaatttgctttaaaaaccgtattcattgccctttctgcattaggggctttttcaacaaccgcaatggtacaagatcctgttgcaaataaagagtatctcgaagttcgccaagtgccttcggctcaaaaagaggtgttagaatttttctctttctattgcccacactgctatgattttgaattaaattacaaaattccaagtaaagtcaaagcaggtttacctgaaggggcagtgttaaaacagtaccacgttgattttttaggtcgtcaatcgacagaattaacacgagcgtgggcattagcaatggcattaggcgcggaagataaggtgaaaaccccattatttgaagcggcacaaaaagatgcaattaaatcaatggacgacattcgtgcgattttcttagcaaatggtattaccgcagaacaatttgacggcggcattaatagctttgcggtgaatggtttagtgacaaaacaaactcaagctgctgaagaatttaaagtgcgtggcgtgccagcattttttgtgaatgaacaatatcagctaaatccagaaggtttctccgattcaggctcaaccaacgaatttgttcaacgttatattgatgcgattttatttttagtgaaaaaatagagtgtatttgcaaaacaagcgttcaatctgaccgcttgtttttatctcacccaatcggctaaccataaccgaattttaatcccccaataggttgagaagccagtagtgtggctaatcattttgccatcttttacaataattaatgtcggagtcgcttgaatatcccaactttttgaaaatgttcctattggatcattgatagtcacaaaatgatattgatgcgctttcatatactgttttacttcatcatcacttcccgatttgagagcaatacttaaaacattgtcgccatctagtacaagctgagaaatggatggggaggtatattcacaaaatttgcaccaactgccccaaaaatagagtaacagtgatttttggtggcttagttgtgcaataatttgaggatttttctccaaatcatataaaacttgttctgcaaattgatgagagggattgggtctacgaaaccaatctgctgcagtgttgatcaatacaaataaactcacaaataacaaaatatttttcatagaacagttgataatgccatgctttttcattttatttcttaccgccagtataagctgcagctcctctagctagcattcttaattgtgtaattacacgttgttttaatttttctcgttcttgactatttaagtctaaagcatgggaacctgctgtgaaaacgagagtaacaagtccttcagattgaatataagctagttcctgagttattgcgtgatctctttgttgaatatattctgcgagttctgctacaaaatgctggatttcacgtgacgtggcagttctaaattcttgcgaggttcctgatcgttctctcagcaaaagacgaaacatattagggcggtattcaataagttcaaaaaaggtttctacagagatagcaataacactcccccctttttctaatctttttctagcttggcgcattaattgacgtaagattaaccctgattcgtctaccattgctaaccctaattcatccatatctttaaagtgtcggtaaaaagacgttggtgcaatgcccgcttcacgggcaacttcacgtagacttaaatttgaaaaacttttgtctgcagttagctggttaaatgcagcatcaactaatgcacggcgagttttctctttttggattgctctgattccactactcattattgaatctctgacattattttttgaatctcttttgcaaggcgttcatatcgcaaccgtaatggggagccagggcgatagattaacccaattgttctatatggttcaggattattaaaatgaatatagtgtaaattatctgtttttccaattttagctgctagttcagggataaacgcaattccttcatctgcggcaaccatattacgtaatgtttctaaactatttgctttaaagtggctgttctcttttgctccgattgataagcaatagtccatcaactgtgttcgtagacaatgccctccatctagcatcaacatttcttgatcgcgtaattttgataagtctattgaggttgttgttgcccatttatgctgattggatactgcaagtagcattttttcattaaaaataggtatttcgataaatggcgcgctttctttgtcaaaagctaaaataacgcaatctagttgtcccgactcaagttgttccacaagtaatgatgtttgtagttcataaatataaagctctaatctagggaaaagttgttttagttgaggaaaaattatcggtgaaatataaggtcctaatgttggaatgataccaatatgtaaggggccagacattgctttaccttggttgcttgccatttctctaagaatcttcacttctcttaacacagcttttgcttgttcaactaaggtaagccctgattgggtaaagagtactttccggctagttctttccaatagcacagttccgagctcatcttctaacttacgaatctgcccactcagtgtgggctggcttacattacaagcatcagctgctttacgaaaatgtttaaaatcagctaaagcgattagatattctagatctcggatattcatataatactagtccccattaaatcaataattaaattatgccatatttgatgacaaaatattaatgttttaaatataccatagagcataacatcaaattacgctatctaaataatatttaccagcctaataacgaacaccctgcaagatcaacatataaccagcaatcatcaacaaaataccacttagcgacctttgcattgtaagcggttttaaaatccctctcagcttcattgaaaagaaactggttaaaaatgaacatagaaccacaatggacacaacggtaaaattcacatatcccacttgccaagagttttctaaatagaccggagggggtttgcttagataaccgtataagtttcctaatccaccgataatcatcatatagttgctataagcggcgatttgatgtggtttgacgcttggtaacaaactaataagaggtgccataattgagccaccgccaatacctgtaattcctgcgacacttccaccaaataagcacactgaaattcccttaatgttctcttttaacgggctacaagcggtggaattctcagatttttttgcgagaataagacgtaatgcaaggacaacaagtgtagtcacaaacactgcaacaattgcccaatttggaatgaaaaaactaatttcaaacccaagctgaacgccgataatcattccagttgaccatagcaacagtgatttcattttgacaggaacacgctgtttatagaaatagactaagttgattgttgctgttcccatcactgtcattaaagaggtggcagcaaccatttgcaacgaaaattcaggaaacagtgtgtgtaaaatcgggaccctatcccaaattctgtgtaaacacccatttcaacttaacggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacagcattcgtggtataaatcgctttacgaatatcagccggataatcaaaaaatgtggcaatatttgcccaattatcttcccagcctttcgctacaagcgggtattttgcctgccatttttgcgaaagtgcggtcagattttcgcgagcctgtgcttccgtcgggacctgataaacctgctttaaatctgcggtgacggctttgtaatctttccatgaaacgaatttcaagctgttacgtactaaatgcacaatgcaaagctgaaactacgatacaatctaggtaaacaattggataaaccgcatcaagtgggcgattttgccatgccattacgcgctctttcacggcgtcggtaacgcgagaaatcaggctggttgatacatccgcatcatagagttctttgaacatttcaacgatttcctgattacttaaccccttggcatataaggcaataatctgctcatccattcctgtgatgcgggtttggtttttcttgataagttgcggttcaaaggtgccgtcacggtcacgaggcgtctcaatttctatctcaccttcatcacaaatgacggtcttagatgtgtaaccgttacgtgcatttttaccttttctaggctgatgcttttcatcgccaagatggtcagtgagttcaccatttaacgcagcctcttccgctgccaaggcgtgaagttgtttttcgttcataataaaatacctgtgtctgaatgtattatctcagaaacaggtatttacacaaattgtgggagaggctctcattagcaaccattttgtctactatgccaaataattggggagttttttacattaattagcccgtctctgttgcaataaccaatttaatacttctgggctattaaatacagcatcccaagtattatgcggattattattaataattccattatctccttctttctctgtgctgaattctgtatatttaacataaggagcatttaactctttagcaagtatttgataattaattctagacccttttactggagaaactttatcttccttactgtgaaaaaaccaaattggtatatttttaattggagataagttctctttagttgcattaccatctatccattcaatagtataagcttctctccctcccattagaagcgctcccgcaaagaaatcagggcgttttaataataaatataatccaccctctgctcctcgagataaccctgtaatataaattctattaggatctatcataggataagaatccaatgtattgtcaatcattttaagcaagagattatgacgattatctgtttgccaatgaattccacctttactacccatagaataattatcaaaagaatcaaaaacactatcgtattgaggagctaaaacaaatccatcttcatactgtaaagtagctatagctcctttacttgatagtaaatgggcaatattgtcttttcctacttgtcctgaaccatgtaagaagattattagaggatatttttctttatttaaagaagatggaatatgtaatctatagtgtaatttattttttggatcattgatggcaaccgatctttctacaaaactatctgtatctgtttttaaattatctcgaagaatcgtttctatccattgatctttatctaacgttttaccattagttaacttcaaaaaacccgtttgttctatattatatgatagtctttccccataaaatactggtactcttattgcctgttttttctcactagagatgatattaccttgaatatccttttctctaaataacatgggattatcattttctactttaatttcgtataaatctgaacccttatctctaacatccatctcagggcaaccgcatatgttgtccatttttcaacctacacgccgagcaacagctcatctcgaaattcatctgaccaaccagcagcggtcaatttccctttcatactctgctttttcgggtgtaatcgtgccaagttcaacgctaatcgacgcaaaattgccagattttccgcaccccattcatcggtcacagcacattcgtcttctttatagaccacatctagcacccaatgggctttgttttccacttcccaatgccctcgcacgcacttcgccaatatttgaatatcaacatccaaactactgatataaaagactttttcttgcgattctttgccattatctgaccgcttgcgacacacctccaacaccgattttatccccttccattcctccgctttgctcagccaatcactcactttcagcttacggtagtaacgctcatcaattcgacgacgttccgcatttacctccttaaacgtctcaaacatttcggggcaatctcggctgattttgtgaaaatacgcctccacttccgactgaaattgacggtgatttttcttcaacggcatcacataatcccctttcttttcgatgattttctccgcaattttcttctgtgtattcatcgcatccaccgttataacggcattttttaagcaaaaactgtcgataatttccatcaccgcctgctgctcattttgcttacccgaggattttttctgcgataaaatcaaaccacgagactggctccacactgtcacactgtgcaaagcactttgggtttccggattgaaactatgacgaagtgtcttgccatcaatcgcaatcacttcacgaccttgttgtgtgcgtatctcattgataaaattaagaaaaacctcattaaacgcttgtggctcaatacgttttattacacgagcgatagtatcatcgacaggaatgccacactcaaaaggacgatattttcgcaaccaatccaaatgtaattcgccaaaaagtttgatttcagtccagctgtttgcccccgaaatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctgacatccatctcaataacaacaaatttaccttgttttgatttaaaggaaatatcaggttgatcatttacatatgcttttaaaataactctatctttgagaggttttccatccaaatatggcgttactttatataattgtgataaatcacttccagacaaaatattatcttcatactttaaagcaagggcttttattttttgacctttagctgtagtttctgctagaaaagttatatctacttcttctgatactttttgaggttgatcatctattccataagcatgagatacacaaaatagacctaataaagcatataaagttttcattttttcctcctaaacaaaacaggctgtaaatatggtatttacagcctattcttaataattaaagatgtttattttgagctttgatatataagccaatacctatcataaccacaacaggaagaacgagatcgaatagtgagccatcattaccccaaattaagttagccaagatgacactaataccgccaataccccaagcaattgtagttggtacagaccagatgatcatttgttttttcacatcattgatgcccatcattcggtttacaacccagaataaactatcgttgaaatatccaaagaaaagtgaacccattgttgctgcctgtgcggcaaggatcatattcacaccagggatctgagctagaattggagcagaaattgatgcagctgtaatcattgcaacagtaccggaaccttgaataaaacgaaccagtgttgaaacaataaatggaattaagataggagaaatcggtaaattcgcaatttgctctgcaagctgagctcctgcaccactctcacgtaaaactgtacctaaagcaccaccagcacctgttacgagtagaataatacctgcagttttaacaccttcttctagatgtaatgcggttgtcgttttgtcagcatgcggaagtaacgtataaacagcaactaagacgctgatagctaaagcaatcattggatgtccaacaaaagcaaatacatcataaagagccatttctgcaatcgtaggatttgattttgccactaaatctaaaatagctttaataaagattagtacgattggcaatacaattgggagaagagataaacctaagcttggtaaattctttttctcacgactttcaatatagtcatcgtatttttgttttagctcttctttactaaatacttcttggttaaattcaggatattttttatctagccattttgcatataaaacaataccgataacaggtaatactgccatagccataccaaccaaaagcattacaccaatatctaccccaaataatcctgctacgcctaatgggcctggtgttggtggaacggtatggtgagttacgactaaaccacccgctaaagctacacctaaagttaataaagaacgtttaccattttttgctaaagcttttgcaactggatataaaataacgaaggctgaatcaacgaaaatagggatactaactacataacctgtgatagctaaagcccactcttcttttttcttacctaacattttgatgaagctatatgccattttttctgctgccccagaaacttcaagcacacttcccatcataacccctaaaccgatgacaataccaataccacctaaagtaccgccaaaacctttactaattgccccaagagtctcatttaccgtcataccgccgattaaacctgctatcgcggatgcaataagcatcgcaataaatgcatgaacacgtgtcttaagaactaaatagactaaaacaaaaaccgcaatgattagcccaatgataggaatcggtagtccaaacataatgttttctcctacatatcatattgaataaattgttgaattacgtctttaaaatcattatcagcagtaaaacctaattgaagagcataagtattgtctatttcagcaggccaacttgcgacaatattgttaatgtttgcatcaaaatcaaaacggactttttctagaataggctctcctttcacttgaactaaatcagataacatctgtttcacactcacggtaaaacctggaagattaatcacatgccaatgacgtggtggaagggatgtcaatgtcatcgcatgaatgaaattattgattaccgtatttgggcttgataaccataaacgtagatcttgtgacactggacaaatcgcttcttcgccatgtaatggctcacggataatactgctcacaaaagaagaggctgctttgttcggttttcctggtctaatacaaattgttggtaaacgaacgacaataccatctacaaatcctttacgactgtaatcattaattagcaactcacacattgctttttgtgtaccgtaagtagattgcggagtaacagcagttccattaacaattacatctggtaactcaccaccaaaaacagctaaagaactagagaatataaaacgtacagcaggattatttttacggcagatttccaataaattccttgttgcaaggaaattaatttcataacctaaatctggatcctgttccgcatggctactcacaattgcagctaaatgaaaaatggcatctgtttcttttgtaataatttgatctaacccttctggatttattaaatccatctctaaacaacgaactcttgaatcaccatttggagcaatcggttttactacatcaattaacacaagctcatcaattttctctgaatgctgatttaataaagtacgagcaagtctttggcctaaaaaaccttgtccacctgtaattactactttcatttctttctctttcatctaaatagattaacgatttttgtatggttgaaaccattgcaagccatcaaccgtatttgctcttggtttgtattcacaacctacatagccttcataaccgatttcatctaatttgttgaaaatataagcataattaatttcaccttcatctggctcatgtctatctggtacagatgcaatttggacatgagcaaatttgctatccaacttatctgtcaatcgagataaattgccatccacgttctgggcatgaaaataatctagctgaacaaatacattttctctctgcacagcttctacaatttccaaggtgtcaaattgactttttaacagatagttaggtttaacttctggacttaacgcttctaacaatactttaatgccataaggtttgaatttatccgccgcataacgcacattctcaatgaatgtttgtttatatgcttctctatcctgatcttctggcacaacagcagccatgacatgtacatttttacaacctagcgctaaagcatactcaagagccatatcaatatccttatggctatcttcctctcgccctggtattgccgaaacaccccattcaccggcagacacattacccgcagcagtgttaaataaaacttgtttcagctcatattggtctaataagcgctttaatacctctttgtcatattcataaggccataaatactcaacatatctaaatcctgctttagcagcagcttcaaatctgtctaaaaaaggtacttcattgaacatcatcgttaaatttgcagcaaatttaggcatttttatttccccttattttctagatccttcacttcactctcagagaggtagcgaatacttttcccttgcaaaataaaatataattttgcagtttcctctaactcttccgtgttatccactgcatccactaaactatttcctgttactacaacaccatggttggcaagtagaaaagctttagcctgtaatgctctttcactcaactctcttgcaatattggtatcaccaggcttgtaataagggataacaggaagttgtcccactctcataacatagtatggtgtaaaagctcttatcgcatttgtagtatcaattccttccaaacaagataaagctgtgagataggttgaatgtaaatgaactatcgctctacactgaggatttgcttgataaagtgctaagtgaaatacagactctttggaaggtttatcaccctcaatgagatttccattcatatctaaaacagataaacgattaacttctaatcgccctaaagatgaacctgtaggtgtgacaagcaccctattatcatcaagcttgacagaaagatttccagcaccgcctactgtgtatcctcgatcaaataatgatttcgcaagttcaaccatttggattttttgtgccaaatccgtcatacaaacatctcctgagcgaatttaaagaaatcctcttttccaaagttacctgatttcaatgctaaataaatcggttcttctaccgcttttagccaaggaaccccaggtgcaatttgtttaccaatatggaaaccagcaaaacctagttgttgaaccacaatgctcgatgtttctcctccagcagtaataaagttagtgatgcctgtatctttaagcttttctgctaaacgagcaaaggtagtttcgatggcatgactcgctttctctgcaccaaattgggcttggattgtttttaatgtttcaggagggactgttgcatataccattggagcaagcggttggtttagatgagaaatcacccattggtagagctgttctacatattcaggattattgatagcttgttcagcctctaagaaatagctaggtgcatgtttctgataaaactcaacttgcttattagtcatcacagaacaagatcctgataaaataacggttttcgctttggttggtgtaaaggcatcagtaccttttttaccgcctgaaattctttcagccatatatgcagccaacccagagccacccgtcactaatttaaaactttcaatcgattctgctaaaacagctaactgagtattgtccactgaatcaactacagcatatcgatagccttgttgttttaactccataaaacgttgtttaacatagtcagcacctttgaataattcagcacagcttactaaaccggttttctcacgtgcctgcatatccattaaacgaacaagattggcatctttcattggtgtgatagggtggttttgcatacccgattcattaagtaatacatttccgacaaagagataaccattaaaaatggtccgcccattgattggtaatgcagggcaaataattgtgaaatcctcacccaatgcatcaagtaatgcatcggtaacaggacctatattgcccttctctgtgctatcaaaagtagaacaatatttaaaatagaactgttttccgccattattttgtagccatttcaacgcatctaatgattgctcaatcgcctcattaactggattcgagcgtgatttcaaactaataactacagcatcaacaggttctactaaatttgatgttggcactccattcatctgaatggtctttaatccattttcaactaaaaaactggcaatatcgcttgccccagtaaaatcatctgcaataacacctaacatcttatttatcccccttttttggtaactcaataccatcgaagatcttaatcactgcactatcatcttctttgccatacccagcattacttgccgatgtaaacatattgaatgcagtacttgctaaaggaagtgggaatttcaatgcttttgcggtatcagtgacaagtccaagatcttttacaaaaatatcaaccattgataatggtgtgtaatctccatcaacaacatgtttcatgcgattttcaaacatccaagaattacctgcagcattagtcaccacgtcatacatcaaatccaaaggaattcccgctcttgctgctaatgccatcgcctcagcgcctgctgcaatatgtacacccgctaacaattgatggatgattttgactgtagctccaagtccaatttcttcaccaatgttataaacttttcctgccaccgcttctaacacaggctctaatttctcaaaagcttctttagaaccagatgccatcacagtcatatcaccattagctgctttagctgccccacctgaaacaggtgcatctaacattaataaccctaaccctgttaatttatgtgaaatttctttagcatcttgggcagaaatggtagatgaaaccatcaccacagtacctttattaaggtgaggtgctagtcccttctctccaaataaaattgatttcacttgattagcattcacgacaagtagtaatacagcatctaatttagatgcaaaaggaatagcgctctctccaatgtcagttgcaccaaaagattttaatgtttctaatgctttagaattcagatcaataccataggtatctaatccttttgtaatacaagacttagccgcccccattcccattgcaccaagcccaattactgcgatactataagtagatttactcataactaactcctcataaaatgatgtctcataaattatgtttacaaatcatacataacaataaaaataaaatctgtgacaaaactcacaaaatttaacaaatttgttaaattttgttaataactcaaggtaacatagatgggtataatgaacaggccgaagataatgtaaggaaagaatatgattccagcagaaagacaaagacagattattcaaattgttaatagttttggtagcacaagtattaattttcttgctaaccgtttgaatgtctcacatatgacaatccgccgagatattcagaaattggaagaagaagggaaaatatcctctgtgtcagggggtgttcagtcacttgagagactgacgacagaacccactcacagtgataaatctcaattatttcacgatcaaaaatgggcgattggaatcgcagcagcaaaacagattcctcataatgccacgatttaccttgatgcaggaacaactacactagaaattgcacatcaaatcgcagaacgcaatgacatcttagttatcactaatgattttgttatcgctcattttcttagtaactcaggtcgatgtgaaatcattcacattggtggaagtgtctgtaaagaaaatttatctacaacaggcatgcttgccgcacaattcttaaaaaacttatctattgatatcgcatttatctcgacttcatcatggaatcttaaaggactcaccacgcctaatgaaaacaaaattcctgtgaaactagcaattatagaagcctctcgtaaaaatattcttgtcactgattcttctaaatatggaaaatttgcgactttttttgtatatcctctcaccgtatttgaccagatcatttgcgataaaggattactagaaaatgcccaagaatctattagcagtatgaatgttaatttattattagtctaagttacactaatttaaaatatttcgttatttgcctatttttgcaaatttatggcaaaatcagaccgcttgtattgaggaggttttatggcaaaagtctatattgttcacggttatactgcatcggcggataaacattggtttccgtggttagaacaagaattagcaaaaatcggggttgagtgttatcgcttgaatatgccagattcaagtaacccaaatccagataaatggctgagacatttggaaggacacatcaccattgatgatgagactatcgttgtcggacatagtttaggctgtatcgcttggcttaactttttggcgagaaactttttaaaacctaaagcggctatttttgtgtcaggattttatcagccattggatacgattcctgaactgagttcgttttcaaatagttatgctgttgcaccaagctgtttagcatttaagtcttatgttgttgccgcgttagatgatacggttgtcccacatccatatagtgatgaattagccaaacatttgaaagcagattatattcgcttaccgtcaggtgggcattttttagatagggaaggatggtgtgaatttcctcttctgatcgatttaatcaaaaaacagatagaatgaaagagaaaaggcgagaattattctcgcctatgttctattttaagccttcctgaacacgtacagcatctacacctttatccgcttcgacacgttcgataaaggacttgaagtgagtgaggtggctaacatccaatccaacacgtttcgcccagcctaacatggtgtagagatacacatctgtgacacagagacgttcaccgaaaaaggcgtggtgctctaagtgatcgttggcaatttctaacattcttaacatattgtccgccgcattttgacgaatttctaccgttaaagcttcatttccttgtgcataaggtggtacacgaaaaaacggagtaaatgctttatggacatctgagttgaagaatgacaaccaacgcattgccttggctttgtcttgtgctgtatcgctaccaaacagtttcgcttcaggatgaaggttatcgaggtaagttaagatcgcaatgttttgtgatagtgcgaaatcaccatccactaaaagcggcaccgcaccttgcggatttaacgccaagtattctggcgatttgattttgtcacggttgaccgcttccgcttcgtacggtttaccaatccattctaacgcagtatgcggaacaaatgagcaagcgcccggtagataataaagtttcataggaatccttaataataaatgctgatataagcttaatgatcatagcacgctattaagcccagtttgcaaaatttttcatgaaagtaaccgcttgtctcactaactgttaacaaaaatgttataaatgttaactttttgttttatttttattttatttatgcataatgaaaattgttcaattagtcactaccaaggagcatatatgatgcataaaaccatgacaaaatatttcttacttagcagtttgactgcaacattagccttgcctctatccacagagctacttgcaaacacacaacctactatgacacaaattgctgctcagcgttatgacagtagcaaagatattttccatcctgtttatgcaaaacacggtatggttgcctctgagcaagaactcgctacacaaattggcgtggatattttgaaacaaggcggaaatgccgttgatgctgctgttgcggttggttttgcattagctgttgtattaccaaatgcaggaaatattggcggtggtggttttatggtactacatgatgcaaaaagtggcgaaaacttcacagtcgattttcgtgaaatggcaccaattaaagctacaagagatatgtatctggatgaaaaaggtaatgttgtagatggcaaatcactttacacccattttgctgtgggtgttccaggaaccgttgcaggcatggaatacgcattgaaaaaatggggaagtctgccactagaaaaaattctagagccatcaattaagcttgccgaagaaggatttatggtaagtggcgccttagcaagtacattaaaagaagaaacggaaacattaggtaaatgggaaagcagtaaaaaaatctttttcaaagatggcagaccattgatagctggtgagcgtttagttcaaacagatttggcaaactcattacgtcaaatcgcaaaagagggatctaaagccttctatgaaggcgacattgcgaaaaagattgttgctgagatggagaaacataatggattgatcaccttagatgacatgaaaggttatcaagccgtcgaacgtaaaccgattactggtgaatatcgaggatacaaaattgtgacaatgccaccgccaagctcaggtgggattcacttagtacaaatcctcaatatgttagaaaactacccattaaatgaatttggttctaatagcgccaaaacgattcaccatctcgctgaaacaatgaaattggcttatgccgatcgctctgaatatttaggtgacccagattttgtaaaagttcctgcgaaagggttaacctctaaagaatatgcaaaatcactcatccaaggtattgatgaagaaaaagcacgcccagcatctgatatcaaaccaggacaaccacaatcttacgagagtgatcaaaccacccattattccgtgatggataaagaaggtaatgctgtagcagtcacttatacgttaaatctcaatttcggtagtggtattgttgccgaaggaacaggaattcttctgaataatgaaatggatgacttctcagctaaacctggtgttgcaaatgcctttggtttaattggcggagacgctaatgctgttgaagggaaaaaacgcccactttcttctatgacaccaaccttagttctgaaagaggataaaccatggttagtgactggtagtcctggcggtgctcgtatcattaccacggtgttacaaagtattttaaacaccgttgatcatggaatgaacccagctgaagcgattgtaactcctcgcgtacaccatcaatggttacctgatgagttacgcattgaggaaggaattagtcctgataccctcaaactcttggagcaaaaaggtcataaaattaatgtcaaagctcctatgggaagaattcagattatccaagcgagagaagatggattttatggctactctgatccgagaaatccagatggtagaaccattggtttctaacgtctatctataaaaaatggcatagtagacaaaatggttgctaattttgtaaaaactatgcctatatgacaaagtggttgctaatgaatattttaattattcttagcaactcttttttatttaaaaaatcctttataaacataatgttatgtttttttcattaatcctgtatgatgcgataatttttcctttagtggtccaaataagttttcaagtctatttgtcgtttttttcgatatttaaatcgccatgcttttcataggtaaatagataatctatataacgtttaaaactatgataagcacttcttacattccgatgtttataaggataatagcccttttcattcggtttctgaccgttcttctaaaaacgctttatgttttaaataccaatgatgtaatcgtaaatagacgtcttttttagaactctgtttaagcgttaatgctattgtttttaattcttttccagctatagattgatgcttttttcgtaatgctctcatcacaatagctaccatatgaaaatggcacatttgcgtcggtgtatccaataaatctttcaatataccccgtatgccgtcgcaggtaattgattgaatgttatagcctttcatacgaagtgaattaaatgctattctgtaatacacatctttttccgttttgatggcacgatggtaaaccacttttttagaaagcgaatccatcagggctaaaataccaaattcacgaccaaagaaggtggtatccgcaataatatttaaatcacgtgatagtggtggatttaatttctttttaagggtaaatgttttattacaagcattacattcatagcgttgaatattatttcttataccatgtttgcgaatgtcgctactgtggcaaaaatgacattttttgggttcataattcaaaaaagtggcttaaagcccgtaatataaggttaagccactttttagcaaccagtttgtctactatgccatttttccctctcgagaaacattagcctgcctatggtggagtataactttgaataaaactttcaatttctaccaaattatctgaaaacagtgttttgtttctatccgcttgagtgagaaagccttgttttaccatattgtcaaaaaaggcttttaaatcatcataatagccatcactattaaacaaaatacacggattggggttttgaccaattctcgcccacgagatcacttcaacgatttcttctaaagtacccggtccgcctgctaacgcaatataagcgtcacctaattctatcattttgctcttacgttcaggcatagaattgacggttatcatctgcgtcaagcccttatgtgccaattctctttcctgtaaaaaggttggcataataccaatcacttcaccaccattttccaacacagtatttgctaataagcccatcaaaccctcattaccgccaccatagactaacgtatgttgatgttctgcaatccatttacccaattcaagtcgcttgttggtgagccaaattattcccgacacttgctccgcaatagacggttattttcatttctttttcttcctattttgttaaagtagtgacagatggtaacaaataatcagagagaacaaaatgcactttcaagaatatcaaaaatgggtgagagaattttatcaactgcagaattggtacgagcgagatgtttttcgtcgccttgcttatctgactgaggaaattggcgaggttgcctgtgccgtgcgtgctattgagattggtcgagagcgtcctgatgaaattgagcaagatgccttacagaaaaaagaaaacttaattgaagaattgggcgatgtgtttgataacttatttatcttagcggataaatacgatattgcgattgaagatgtgattgctagacatcaacaaaaatttactaaacgttatcgtggggaataaacaagcggtgagatttgcaaaaaattttgcagatttcaccgcttgtcacatcaatagctaaagtaaaatactaccaatataagcaataataaagcctacaacaccaatagaggtttcaagggctgtccaagtttttaaagttgttttctcatccatttctaggaaacggcttacgagccagaaacccgaatcgtttacgtgagaaagtactgtcgcaccagaggcaatagaaattacaataaagcagagatcaaattgagttaggcttgtatctgctgcaaccattggtgcaattaatgctgctgttgtggttagtgccactgtcgcggaaccttgtgcaacacggaaagtcgttgcaatgataaatgccgccacgacaattggcatgcctgtatctgacattaaagcagagagttcgtcaccaataccacttgcacggagcacgccaccaaacataccaccagcccctgttactagaataatagagcagattggtcctaaagcgttgttacaaattttttcaatttgctcatagctacgattgccttttaacagcagaatcgcaaccaccaaggtaatcaataaggcaacaggtgttttaccaatcaaacgtaaactttgaacccaaaggtctgaaccatctaccactttagcaacggttaatgtattcaatcctgtatcaaataaaatcaagaagataggtaataacagaataatcagaacacgtttaaagcttggcggattttgtaccgctgtatcattcacggccaatgaatttaaaaaggcttttggtaaagccacctggatacgtttactcacaaacatactgaataagtaagtaccaatataccaagttggaatcgcacagattaatccgacaatcaccaacaatcccatattagcccccagtaaatcaccagaagcaacagggcctggatgaggaggaaggaaggcgtgcatcacagcaaaagcgcccgctgatggtaatgcataacgtaatactgaaccgccaaactgttttgccacactgaaaataatcggcaacatcaccacaagtccagcatcaaaaaagatagggaaaccaaaaagtaaagaggccacaccaagagcgaatggtgcgcgtttttccccaaatttattgattaaggtatccgcaaggacttttgcacctcccgtaatttcaagtaagcgaccaatcatcgcccctaaacctaccaataaagcgacagatgctaatgtactaccgaagccacctaacaaggctggtaaaattttatcgacagagatccctgtcgctaacgcagttaataaactcacaataattaaagccacaaatgcgtgcactttaaatttcataatcatcactagtagcaaaataatcgctacaaccatcgtaaaaattaacatataaccccctaaggcataaattgttactggtaacatattattttgtatctaaaatgtaaacggaattctcaaatttattttaaatctgtgatcttgttcaaattttgaataaaattttcataatttaatctatcaacgtgttacattatggaaaaatttcagttatcggtaacattttgttgtaggagaaccgttatgtcagaagggaaagcatttattttaatgggcgtatcaagtacagggaaaacctctatcgggacagaagtcacacgccgtttaggtatgaaattgattgatggcgatgatcttcatccaagagcgaacattattaaaatggggaatggcattccactcaatgatcaagacagagaaccttggctagaacggattaatgatgcggcatttagcttagaacagaaaagtgaaaaaggtattatcgtctgttctgcgttgaaaaaaatctatcgagatcgtattcgacaaggcaacaatgatgttaaatttatctttctaaaaggctcttttgaattggtgttagaacgtatgaagcaacggaaagggcattatatgaaaacagatatgctgaaaagccaatttgcgaccttagaagaacctcaggcagatgaaaaggacgtgatttttattgatattgatgcaccttttgaaactgtggtagaacgttgtattgacactatcaaaccactgctttaaatactctctcccaaatgaatttggtagcctaagttgatgatactactctgctgtgcttcaccctttagacgattcaatagctcttgggctgcaactttgccgatctctaaacggggagtaatgaccgttgctaattgtggggtgagtgattgccccacatcgtgcccatgaaagcctgcaatcgccatctcttttggaaccttaatacctaagcgttggcattcaaataaagccccgattgctaaatcatcattagtacaaaaaataccatcaatatcaggatattgtgctaacgcctgttgaagttgttttgcaccaagggtaaaagatgaaggctcatcggtaatcaaactatgcggttctaaatgatattttcgcatggcttgttcatagccttgcattttcaattttgtccgtttatccatacgagcagtaaaataaacaatatttttatgtccacgactaatcatagtttcaaccatagattgtgctgcagaaatattgtcaaatccgaccgcttgttgaatgccaatttcactgctatccatgatctcaatcactggaatattcgccacctctaacatcttcaaagtacgtttagaatggtgattttccgacagaataatgccatccacattataggagagtaacgactcaattcgctgttcttctttctcttggctataaccatagtgagctaacatcgtttgataacctgccttatccgtgactaattcaatacctttaatcacatcagcaaagacttggttggttaaagaaggcaccaacactcctatggctcggctttttgcattcgataaaatatcaggtgctcgattgggaatatagccaaattctgtaatcgcttctgcaattcgcagccctgtttcatgtgcgactgcttctggattacgcaaataacgactgatcgtcattttagtaatccctaaatgatcggcaatatgttgaagcgttgggcgtttacgttttggtgccataaatagaatagataaaagaatagatgacttattctactgaaatttaagagaggttccaatggagaggcaataaatagaaatgatcaagcggtgagattcgcaaaaaattttgcaaatctcaccgcttgtattccttatttctctgaagagaaacccgatttcaccccgtgcatatttggcaactggtgagcaatccctttatggcagtcaatacaagttttaccttcttgttcagccattgcgtgcatttttgccgccacatttttttgctgagtgaagtccatatcgctgaagttatggcagttacggcactcttgtgaattgttggctttcattctcgcccattcacgttgagccatttctaagcggtgtgcttcaaatttctctttggtgtccactttgcctgttagatgagcaaaaacttcacgagatgcgacaattttgcgtgtccatttcggaataaattcgtgcggtaagtggcaatctgcacagtctgctttaacaccactgcggtttgagtagtgagcagatgctcgatactcaggcactacgtcgttcatatgacaacttgaacagaactcttctgtattagtatgctctaagccagcattaaaaccaccccagaataaaataccgccgatcgcagaaacgacaatgagaaaaccgatgccgattttgcttggggttttaaaccacgtccaaaattttttgatgagcttaaacattatttacccccaaatgctttggtcggttcaaattggttttcgataattggatcaacatttgcttgtggaacgtggcattgtaagcagaaataacgacgtggtgatgtgtcaccagtcacattgccgttacgatccataaagtgtgttgggctaatgcggggtgcacctgtggtacgatagttctctacgccgtgacagtttaaacattggttggtgtttttggtcacttggtagcctttaatgctatgtgggatcattgggggttggttcacatagctaagcggtaactttccttcatcttttggcatattgtggaaagcaggttcaatcgcttcaacacctttatctgcacttgacgggactttttctacattcgcaaaagccacacctgttactgcgattaataatagggcgagatattttttcatttttcactccgttcacgttcaaaacgtgttgtaaaactaaatacattttctgcacagacatcaacgcaacgtccgcaactaatacaatctttcgataacactatttggctatcttcgggtttaccatttaagggtaagcgtagtacctgtggttcagggcaaacgtggaaacaatccatacagcgatcgcatttcgcacgatcaacaacccttactcgtacaatgctttttgcaccgattaaaccgtaggttgctccgattgggcagagatgtccgcaccaaccgtgttccacaatcaataaatcaaataagaaaaccgctaacactaaccaaagcgttgcaccaagaccaaagacgaacactcgaccaagtgctgcaacggggttgatccattcccataataatgtgccagaaatggctgatccgactaggatcattgctaaaataccgtaacgtaatgaacggggtaatttagcggattgacggatcccaagttttcgtcgtagccaagcggcacagtctgtgacgatattgacagggcaaatccagccacagaataccttgcttgcaagtaacgcatatattgccacgatgatcgctgcacccagtaaggttttccattcaggcaaatagcctgttgcaaggctttctgcagtaatcagtggatcggttaaagggataagatcaaatagcatacttgagctgtaattcccttttaagatccacacattccacataggaccgcttaagaacattaacactacactgagctggctcaatcggcgtaaaatcaaaaagcgataagcacgccaccaacctaatttttgtcgggcttcaagccctgcgtctttcggggaatttgccattatttcaccccttctggcatttgtgttggtaaggaaataatgccttctgggttggttttatcaagcagagaatgccctgctttctgtttttcttcccaaccaagtcggtaatgtttgcctaacattccttttgccaacgacattggcaatactttgattgcggcttcttctaacacacaggcttcttcacacttaccacaccctgtacacgcatcggaatgtaccgttgggataaacattgcgtgtttacccgtacgatcgttgcgttgcatttcaagggtgatcgccttgtcaattaacgggcaaacccgataacacacatcacaacgtaaaccttgccagttcaaacaggtttcgtgatcaagcagaacggataaacccattcgagcatcatcaatattcgttaaatttggatctaacgcaccgcttgggcaagccttaacacaaggaatatcaggacacatttcgcacggtttatcacgagcgataaagtaaggtgttcctgcttccattggtgatagcaatgaagccaaatgcaacatatcgtaagggcaagcctgtacacattgtccacagcgaacacaagcggcggtgaaatctttgtcatcggctaatgcacctggtggacgcagtgccacgccttgtcgagcaaggctttggttttgttgtaaggctaagatgatccccacaccacaaacaccacctgccgtgcgtgtcgcattttttaaaaattggcgacgatttggatcgagtttcaatgcctgttccttatttgcaaattgttgctcaaatctaaccgcttacggggtatctgatattcttcccccatttatgggggaagtaccgccgcaggcggggatgggggatatcaactatgcccccgtcggtttcgcttcgctcaaccacttccccccacaggtgggggaagtgttcctggctaagccttcacaactttaaccgcacattttttgaagtcggtttcttttgagattgggtcggttgcatctaaggttaatttattggctaactgacctgcatcgaagaaggtggtgtaaattaagccttcaggcactttgttacgaccacgggtatctaaatgcgagatcatctcgccacggcgtgaaattactttcactttgtcgccgtgacgtaaaccacgtttttgagcgtccgttgggtgcatccacactaagttattcgggaatgaacggtgtaattcaggtacacgacgggtcattgagcctgagtgccagtgttcaagtacacgccctgttgataaccataaatcatattccgcatctggtgcttctgcaggtggctcataaggtacagcaagaataatcgcttttttatctggataaccgtagaaagaaacgccttcgcctactttgacatatgggtcatagccttcacggtaacgccataaggtttctttgccatccacgactggccaacgtaaaccacgtgctttatgataagtttcaaagtctgctaaatcgtgaccgtgaccacgaccgaatgccgcatactcttcaaataaacctttttgtaaatagaagccaaaatgggttgactcatcattgatgtaatcagctttatccgttggtacttggaatttatccacttgaccattgcgatataacacatcgtatagtgttttacctttatattcagggtttgctgctaatacttctgctggccacatttcatctgtggtgaagtatttagagaactccactaattgccataagtctgatttcgcttcgcctggtgctttcacttgttggaaccagaactgagtacgacgctctgcgttaccataagccccttctttttctacccacattgctgttggaagaattaagtctgcagaaagtgcagaaactgttgggtatggatctgacacaacaataaagttgcgttcgttacgccagcctggcatacgctcttggttaatattcggaccacattgcatattgttgttacacattacccagtaagcattgagtttaccgtcttttaatgcacggtcttgtgctacagcgtgcaagcctactttagtttggataacaccatttggtaacttccataatttttctgcggttttaacgtgttcagggttagtcaccactaaatctgctggtaagcggtgaataaaggttcctacttcacgcgctgtaccacaggctgatggctgacctgttaatgagaaaggcccacaacctggtttagaaattttgcctgtcagtaagtgaatgttatagatgagatggtttgcccacacaccacgaacgtgttggttaaagcccattgtccagaatgaaacgatgttcaagtttggatccgcatacattttcgcaaggctttctaactgatcttttggcacacccgataattcgtgtgctttatctaaggtatattcagaaacaagctgtttaaactcttcaaagctactgtcgtacattttgcctgcagtttttgcatttttagccacttgttctaatgggtggttgtcacgcagaccgtaaccgatatccgtttcaccacgtttgaatttagtgtgtttttggataaagtcttggtcaatcgcattgttttgaatcaagtaatttgcgatatagttcataatcgctaaatcaccttgtggtttaaatacgataggcaagtccgcaagttcaaaagaacggtgttcaaaggtagaaagaaccgcaacttttgcatcttgtttggataaacggcgatcagaaatacgcgaccataagatcgggtgcatttccgccatattggatccccaaagcacaaatacatcggctttctcaatatcgtcataacaacccatcggttcgtccataccaaaggtacgcataaacgcaaccgctgctgaagccatacagtgacgtgcattcggatcgatattatttgaacgtaaacctgctttaaatagtttagattttgcaaccccttcaaagatcgttgattgacccgaagtgaacatacctacaccatttggaccttgctctttaatcgctttcttgaatttttccgccataatggtaaatgcttgatcccaagaaacaggggtaaattcaccatttttgtcgtacttaccgtctttcatacgcaacattggcgatgttaagcggtcttttccgtacataattttcggcaggaagtaacctttaatacagttcaaaccacggtttacttcggcatcagggtcaccttgagaagcaaccacacgcccattttgcgtaccgacaagcacgctacaacctgtaccgcagaaacggcaaggtgctttatcccatttaatgctattgtcgttagcgtacacatttttcacaggtaacgtaatacctgcggcgagagctgctgctgccgctgcattcgctttcataaaatcgcgacgattgagttccataaattccccacaaaataataggtaataccaaattaaagagcttcatcttggtggctataaatcagcgacaccacgataaccccttcaatatctttaatcatctccatacgatcaaccaaatcaggttgataactggactccaaaacaaccacgagtttactttcttcaagtttcaccccgtggatttccgtattcggtaactcagttaaggcttgcttcaccaagtccaacttttcaggtttcacttgaactacaagactgcaaacataccagttgtccgcttcgtcatagttcaatttatcagatacatttctcattattactctcttttatccctatcccgtttacgggagagggaggagaaagcctttaggctttcggagggagagggctttggacatttctcaccaaagtgaccgcttgtgtcgggcaaactgccatacaagccccacaaccattacaactttccacatttaattcaggcattgccactcgccccacttgtcgcttaaagcgaatagcgcggctttcacaactatcttcacaactacggcattccacaccgctaaacgtcatacagctttgctgaatttcaacataatgaaaccacgctcgctcatctgttgaacgaaacacatcggcttcacacgccttcacacacgcctgacaaaaagtacactccccacgaccattcataaaattgacttcaggataaccaccagcccctttcactaaaatttgcgtttcacacacagcaatacacttatcacaagcggtgcatttatcaaaaaaatttgcaagatcagtccaaggtgctcgaacggcttgatgcccttgctgagccactttttcgtcctgaagtgatttcaaaaaatgtccacgcaaaaagctacgacgaggtaaagtcgtttctgtaaaattagccaaaaatagtttactaaatggataggttatttatgttaatgattgtaacatttataaaacataaaaaatgcaaacaaaatacattttatgaatgttatttgacaataatcaataaaaaagcggtgaaaatgatttaattctcaccgctatatatttgattttataatgcttttcttaacactgtcttgccttaaagcgagggttcgttttacaaatcacatataatttgcccttacgacgaaccacttggcaatctgggtggcgtgatttcgctgatttaagcgaatttaaaattttcattttgtccccttttatttcttattttttcgttaagctcgaaatgcctttaaagcgttcattgaatttgcttgcacgtccttcagtatttgcttcacggcgtttacccgtataaacagggtgagaagcagaagacgtatctaacggataaagtggatactctttaccatcttcccacaccattgttttatttgttgccgcacaagagcggataatccagccttgttgcacactgccgtcgtaaaataacacttcacgataattttcagggtgaatcccttttttcatatattctcctagtcaaaaactcagacttaaaaccataaattaaatatgggattattttgcctgaagcaaaataaaaaagctataatttttttatggtctttgtcacttttttcaacttaaacacaaggaaataacgaaattgcgaactggatctaagtttcttagcaataaatatgctaggctattgctattttgtaagtaggagatcagacaatggcaaaacaaccttatctcatcgccccatctatcttatctgcggatcttgctcgtttaggcgatgatgttgcagacgtattaaaagcaggggcggatttaattcattttgatgtaatggacaaccactatgtgccgaatttaacgttcggtcctgcaatttgcaaagccttacgggattacggcattacttgcccgattgatgtacatttaatggcaaaacccgttgatcgcttaatccctgattttgcaaaagcaggggcagacatcatcaccttccacccagaagcaacagagcatattgaccgctcgttacaacttatccgtgaacacggttgcaaatcaggcttagtatttaaccctgcaacgccgttaagctacttagactatgtaatggataaagtcgatgtgattttattaatgtccgttaatccaggttttggcggacaagcattcttaccatctaccttgaataaattgcgtgaagctcgtcgcagaattgatgccagtggatttaacattcgcttggaagttgatggcggtgtgaaagtcaataacattgctgaaattgcagaagcaggggcagatatgttcgttgcaggctctgcgattttcgatcaaccagattataaagctgtgattgatcagatgagagcggagttggctgtaaaataatactgtaaaatatctaagaggttaaccagattaaaactatttattatatctatcaggttaaccccttaatgcccttaaatttcatcaataatccgatacacccaattctcaagcgggtcgttcagacgtttcatttccaaacgcatctcttcgagcatctcttttttgattgctttgtaagcgtcatcatagaagagattgtgcatttcctcaggatctttgcggacatcataaagttcgcacaaatccgtggcgttgaagaccagtttgtaatctttacgtcgccacatacgctgttcaaagtaaacaaagtgtcctgcaagttggcagagcaagcctttgcggtcgttctctttgttttctctggtgatcggtaaaatggtttccccttggaactctggcggtacttcttgcccagccacatcatagaccgttgaggttaggtcgtgaagatagacgaggttgtcatcaacttcattgacacggttagattgtgggtctttgatgatcagtgggacgttgtaggtggtttcaaacataaactcacctttttcaatcatacgatgtgcacccattgcatcaccgtgatccgctgtggcaacgaggaaggtgttttcgtataagccgttttcttccaagaaggtaaacagctcaccgatggcatcatcaattaaggtgatgtaaccccagaatttggtgatcacttctttccaactctcttcgctggcttcccacattccccacatttttgagatggtgcggaaatgccctggtttgccttcaagcggtttgaagaaactttcatctagcacaacatcttttggatcgtacattgagtaataaggctcaggcacaatgcaaggggtgtgtggtccccagaaattgatccaagtgaagaacggtttaccttcagccagcgactcgcggatatattttttcgcttcgtcaatgatgaagtattcaatggtttcttcttttgtgccagagagcaaaccacataactcttgtacgcgtaaatgagggttatcgccaaagtaagctcggctgacttcagggatttcatagcctttttcttctaaccattcacgataacggttcgagtgtgtcggtggttggttgaacaccagatttttatagacttggctacctgggtaaccgtagccgtcaaaattgtgtcctttaatcccgtaatcttcaggaacagattttgtgccgacgtgccattttcctacgacataagagttgtatccttctaagttacagatattcggtgcctgttggttgatttcccctgtgccacctttttcgccgttcttaataataccgtgactagatggcattaagcctgtaaacaatgatgttcgagcaggtccacacacagaagcaggcgtaaaggcattattgaaacgaataccgtccgctgcaagtctgtcaaggttaggggttttgacaatttggtgtccgtaaggaccaagcatatctttgcggacttggtctaaaagaatgtaaacgatgttgttcatagcaatatccatttttgaatttccttcccccgtttacgggggaaggtgccgaaggcggaaggggggctacgctttatctaccactttctttttaccgaagaaaatcaggataagcacttgcaccacagcccatacgcccataatcattgtcgcattgccttctgcggaagctaaaccaagcggtgataacactaagtgtaaggtaattaagcctaacactaatgaagctactgcagttcttgcatattcccagtgggttaaatctacatttgaatgattgacttggttatcttcgtatggggtcgaacgttttaagaactgacctaagataagcattaacgccacatcaaagacgaagagtgaacccattacatacacaaagtttactttcacgttgataatccaaacgagggtaaagtaaagcacaacgtggactaacaaggtaatgcgtgcggctaagcctgatacatagcggttgaacaatccaacggcaaagagtgccacgataggaatgttaaagaagccagcaaaacggcgagtgaataagaagataccgtctgtaccgaacatcaatagcggtgccacaaccattgtgataatcgccataatagtaccgacttttttcgcataactgataagctctgcatcggtgcgtttgactttagtaatcgcaggcaataagtcgttacaatagatggttgccgctgaatttaagaatgagttgaaggtacttaaaatcgctccgaataatgcagctacaaagaagccttgtaaccaagtcggtaacactttattgactaaacttgggtatgacgcatcaattggttttaagccttcaccaagaatgtgatagcttaataagcctggcaagttaaggattaacggtagcaacaagaggaaaagtgctgcaattaaaatccctttttgacccgcttttaaatctcttgcccctaacgcacgttgcacaatcgcttggtttgtggtccagtagaagaagtttacgattaagatacccgtaaagatagccggccaaggcacagcgtctgtggcactaccaatggcattgaatttctcaacgtgggttgtaccgataatgtgtaaaccttctgaaatactgccattacctaaataagcaagagcaaagataggcacaagtaaggcaccgatcactaagatcactgcattccaagtatccgatacggcaacagcttttaagccgccgaaaatcgcataaattgcaccgatgataccgattgcaatcacagtgtaagtaatcgcttcgccatagctaagattaaacacttcttgtaggctgaagattttattaaatgcaatcgcccctgtataaagtgcggttggaatagcaatgaaaagataaaagaacaagaagagcgtggacataatcaaacgagtttgtctgtcgaaacgtgcttcaaagaactctggaatggtggtgtaaccgttacggatatattttggtaacaagatataacgcaaggaaacagagtggaatgactgattgtacagtccacgccataatcgagaagttacctgcataagagtttgcattgatcccaattaactgttccgttgaaagtgaggttaataccattgagcagccgatgactacaccagagcctctcccacaatttgtgtaaatacctgtttctgagataatacattcagacacaggtattttattatgaacgaaaaacaacttcacgccttggcagcggaatttgccaaaaacctaaaaacaccagaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgacggcacctttgaaccgcaacttatcaagaaaaaccaaacccgcatcacaggaatggatgagcagattattgccttatatgccaaggggttaagtaatcaggaaatcgttgaaatgttcaaagaactctatgatgcggatgtgtcaaccagcctgatttctcgcgttaccgacgccgtgaaagagcgcgtaatggaatggcaaaatcgcccacttgatgcggtttatccaattgtttacctagattgtatcgtagtttcagctttgtattgtgcatttagtgcgtaacagcttgaaattcgtttcgtggaaagattacaaagccgtcactgcagatttaaagcaggtttatcaagcccctacggaagcacaggctcgcgaaaatctgaccgcactttcgcaaaaatggcaggcaaaatatccgcttgtggcgaaaggctgggaagataactgggcaaatattgccacattttttgattatccgactgatattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccgttaagttgaaatgggtgtttacacagaatttgggatagggtccctttaatttatactgggattttgagtttaaaacaacaagttgattgttttcaaagttcaaattatctctggcagaaataataggaatttcatttgaaggaacttttttctttttctaataaattaaaatcaacaatgatattactatcagaaatattgatttgataaccttttaaaatattccctaaatagagatgaatagaagaattttcaatattaaattcatcggaaaataaagcgtaactgttttctttttgagtataataagagaaaacataaaaatcgctattgaacatattaagttttttaattctaccaaaatcagaaatgttagctttatttgaattgcacgagaaatattaattaacccttgttcataaactttatcaatccctttttctccaacatcgtcagtggttgaaataataacatttttgatttgatcggttgttaaaaaagataaatgttttttatagcagaagctaaaccataactattgggttgaaaaagatgtacccctaaattgttggttaattcattacgaacgtttgtaataacacaaatatctgctagcatgccgcaccaatttcttttttcgttataagtggatgttactaaaatgtttttagataaatcaactcctttttctttgaaaagagtaatccacatattgccttcttttaaacgattattaccttgtgataacactaaaagattatcttgtttaaaaagttttttataagctgaatatatataataattaaaaatcttttaattcttcttttttacttcattttcttcataagcattactaaaattcatatacttaatatttttgtatttttttatagcatgataaaaatcatttggatttccaacctgaattaaattgattttatttaaaggagaaaatttatcaacaacttgatatacttcaaaatcatgattatcaactatattagtatgtgtttttaaatcgctataaccaaaaccaatagcttcaccataaaaagcgtttggttgttgttttttataataaagaaaattatcggtaatagctatttcatgacttttttattactgaatacaccaacagaatcttgggttgatttgtaatatttaccatttatgttttttgcgattttgtatgtgttttcaatagggtaaatccagttgaaatcagttgtattaaaatcatttttatttttaaaaaaacttgtgatgcatttggaaattcatattgtttatatttttctaaaggtaaatcttttccattaaaaggagtttctttattgtttggaaatgcataactattggatattaaaaatggtataagagtagcaagtagcaaaaaggttttaaaagattttttcattctctcatccttgtttattaaaagaggtatagtacgaggttttaagccagtatccaccaatagttttgtatactatgtttgttagtattatgtagaacttaattgtcacataatattaaccaaataaaaccttaagggaaagttgtgttattttgaaatcggctcaaccctcgccaacttcaccatattatcggatacttcaagtaccgtaacttttaaattaagtagggtaaattgcgtatcttcgtcagggattttttcaagatgttctaaaattaatccattaaaggttctgacttcatctaatggcaaattccagtcaaagagtttatttaagtcgcgtaaattagctgagccttcgatcagcacagagccatctgattgtggcttcacttcttcttccaatgatggtgcagttgaagtggtaaattcccccacaatttcttctaaaatgtcttcaagcgtaatcaaccctttaatatcgccatattcatcaactactaaaccaatacgttttttgttatttttgaaattcatcaactgggtatttaatggcgttccttctggaatgaaatagatctcatctactgcacggataagttgctctttagtaaattcattacgttctaacattaagcgaaacgcctctcgaacacgcaacataccgagcaagtttttatccatatcgcttttataaatcacaacgtgagcgtgggctgcacctgtgagctgacgcataatggatttccaatcatcgtcaatgtcaatactgccaatatcattgcggggcaccataatgtcatcaacagtaactttttccatatcaagaattgacactaacatctcttggtgagccgttgggataaatttccctgcttcaagtacaacccctcgtaattcttctgcacttaatcctgatttttcagacttgcggatacggaataatttcatcaagccattaatgatgaggttcataaagaacactagtggcatcaataatttttgtaatggcataagaatataactgacagtaaagccaactttttcaggatacagtgcggcaatggttttaggtaaaatctcagagaaaaccaacatcacaaaggtaagtaatcccgtagcaatcgctacacctgcttcgccagataactgcataccgatcatcgttgcaattgcggaagcggcaatattgacaagattattacagattaaaattagacttaataaaacatctgttctcgataacagtttttcagcaagttttgcccctttatgccctttatcagcaaggtgacgcatacggtagcggtttaacgacattagccctgtttcagagccagagaagaatgcagaaagcaatagaagaatagctagtgtgatgaataaactactcagggggatcgtgtccaaaataaaagtcctatacttgttagtcacaagcggttagataaataaaaaatttgcaatacagagaacaaatctaaccgctaccttagtggtattacaccattcgactgccaaaataggcaaccgaaagcagtatcatacctgaaattgaataaattagcacccgatttcctcgccagcggagtttccattgtcccaataataagatgttatacacaatccacgcaatgaaagaaaaaatcgctttgtgaatatgttctggtgcaaagaagttgtgtaagtagatcattcccgtgacaagagcgactgtgagcaatccttgagccaccattgttaaggtaaaaaagtgacgttcgacggtcattaatggaggcacaacgggagaaaatgccatttttttacttttaagatttttgtctagccatttaagttgagccgcataaagtagagcgataaaaaataacgcataagaagcaatggcaatgcctaaatggagcattaaccctagattttcggacagctgtttaataaaactgcctgcgacaaaggtagataaggtgacagtaacaataccaagcggataaatcacagacaacggaaaccacaccgttttccatcgagttaaagcgaaagtcgccacagcactaataatcacactgatcagagaagcaacatttacaatggtaaaattttgtccaccattgacaaccagatgttgagaaatgctaataatatggcaaagtacagcaactaagcccaaaagcaatactgcacggatattcggttgtttatccgtatcaagatgagcaagtgttggcataatccataataaagcacctaaataagccacaatggtcaataccgcaaataacatttcaatttctctctcaattaagaatggttttcaataggtgtaaattagcagttttatcgctgttttgctatggaaaaatagaaatttttcagtgtttaacctaatacttcaatctcttttggaatgagcttcggttcaggcacaaaaatttgcttatggcgttgtaattcgcccttttccaacacaatactgcttttggggactttaaataacttacttagatatttcagcaagtgagcatttgcctgcccatcgataggtggagcggtaatagcaattttgagttcgttatcgtgtaaaccgacaatctgatctcgacttgctttcggttgtaaaaaaatccgcaagcggataccttgcggattttcacaaaattcgaccgcttgcattacgccacagcccatagttgtccaaagacttggtaaaacaagctattaataaagagcaatgcaaaaccaagaaccattacagagaagtctaacatacctgtttttggtaaaattttacggataataccgagtacaggctcagtaatttgggcaacggtataatctaacgggtgatttccctgtgtcacccaactcattaaggctcgaattaaggtggtaaaaaagagaatttgcccaaagattttgatgatactcaataagccgataagcacagatcttggtacatcaacaccaaataacacaaattgtaatgcaacaattcctgcagctaaaagcaatgcagcaaaattaatcccttttaccgttgggatcagcttgcttaacgggtttaacacaggattggttaaacgcattaacgtttgtgaaatcggcatataaggatcaattcgacagaactgtagccaagtccgcaacactaacataaagctaaaaaaaccaaccacaattttaataaaaggggctaagaattccattttatttctccaaatataactacatctgaagttacaatctcatcggcataatcacatattccgccgtagcattatcgcaatcttcaattaaacagcttgaacttgcatctacaaggctgatacgcacacgctggcattttaatgtgttaagcacatctaacagatagctcacattaaagcctacttccatctctgcactttgataagagacatcaatgatctcttccgcttcttcttgctctgggttatttgccgtaatttttaacagattttgatttagggctaaacgcacgccacggaagcgttcgtttgataaaatcgccgcacgcactaaggcacgttttaacacttcagcatctgcctctaaaatacgatctgcattgcgtggcaatactcgacggtaatcagggaaacgtccatcaatcagttttgatgtaaatacaatgccattcattgatacacgcaagttgtttgtaccgatttctaggcgaacactttcgttattatgacccaccaagcggactaattctaataccgctttgcgtggcacaatcacagaatgggttaaaagctcttgatttaatgccattgtacatacagcaagacggtgtccgtccgttgccactgaacgcaataaattgccttcagtttcaaacttcataccgtttaagaaataacgggcatcttggtttgccattgaaaattgtgttgcttcaattaaacgagctaaagtcgcttgttcaatcgtgaaatctacttcaggtttccagtccattaaacttgggtaatccgaagcaggtaaggttgctagattgaacttactgcgatctgcacggataaagacacgatcttcatcaaactgcaccgaaattacgctatcatcaggtaagctacgacaaatatctaaaaactttttcgcaggaatagtaaattttcctgagaaactgaccgcttcaaacagctccgcttgggtagtaagctctacctctaaatcagttcccgttaaagataaacggcttccttcaatttctagcaaaatgttgttgattacaggtaatgttggacgactggttaatacgccacaaacctgttgtaacggcttgagtaactgctcacgggtaatagtaaattgcataacaattccttaagacgataatttgcgtgttaaattggtgtaatcttcttggatactgttatcagtatctctcagctcattaatggttttgcaggcgtgcatcaccgttgtgtgatcacgtccgccaaattcacgtccgatttcaggcaaactgtggttagtcagctcttttgctaatgccattgccatttggcgtggacgagccacggaacgcgtacgactttttgattttaaatccgccattttgatattgtaatactcagcgacggttttctgaatattctcaatggtaattaagtgatcgtaagaggcaatcagatcttttaaggcttctcgtaccgcatcaattgtgatctgacggctggtgaaattgctccacgcaattgcacgatttaacgccccttctaattcacgcacgttagttctgagtttttgccctaagaaaaaggcgacatcttcacttaattcaatgcctcgttcttccgcttttttcattaaaattgccacacgagtttctagctctggcggttcaatcgccgcattaaccccccaacttaaacgagagcggatacgttcttctatattctcaatgtttttcggaaatacatcggaagtcacaataatctgcttacttcgttcaaataaggagttaaaggtatggaaaaattcctcttgtgttgcctctttgttcgcaaaaaactgaatatcgtcaatcatcaacacatcaagagagcgatagaattttttgaaattctcaatggtgttcgctttaatcgctttgaccatatcctgcacaaaacgctctgagtgaatataaaccactctcgcattcgggttttgtttcaggatttcattaccgattgcgtgcaacaagtgcgttttaccaagacctgttccgccatataacgaaaatggattgcagtggctttcaccagggttacttgcaacctgttgagcaacggctttagcgagttggttagacttcccttgaacaaagttatcaaaggtgagcgtttcagtaagtccagaacgtaatgcagtagcttgcgtttcttgcggtggcgttgcagttggtgcaacagaagtcaccgcttgttctgctggtttgatccctactcggatctccacttgcaactgctcatttttgcttaaagatcgagcaagggtaacaatctcccctaaaaatttatctttcacccaagttgctacaaactgattatgagcgtacaacactaattcagagctagttgcactcgcttgcaacggacgtagccaagtgctgtaatcagttggcgatacttttgcttgtaagtgagttaaacaatcagaccaaagggaagacacagtttgctccaaattaatagggttgagaagatcgttatcatacccgaaaaaatgatcaagatcttgaaatttttatggattaaataatttatttctcaaatacttgtagatttttctgaccaaaaatagattaaaagagaaccgatgaatttatgttttttgataaaaataggcggaatatataatgcatatattccgcacgacttctcacattatgtaggattaaataactacattcgcaattgccacgcctacacaacaagcgacaagtacaccaattaatcctggaaccataaagctatggttgaagtagaatttaccgatcttcgttgttcctgttacgtcaaagtttactgtcgcaatatctgatggatagttaggaatgaagaagtaagcgtaagttgcaggcattagaccaactaataatggagcgggcaaacctaagtcgataccaacaggtaacatcattacggcagttggtgcttggctgttgatcaccacagatactgcaaaaagagctaatgcaaaggtccaagggtatgtttcaaccatttcagtgatacctgctttaaattgtggcattgcatattggaagtatgtaccactcatccacgcaataccgaaaatagcaattgctgcaaccatacctgatttaaacaccacaccatttggtacagtttgtggattagttcttgttgcaagaagaataataccaccaaagcagagcatcatcatttgaatgataagtgacattgaaattggtttcactttctcacctgttgccacagtacgaatttcagggaacattgcgattacaacaatggtgattagtgaaagtaagaataacaatactgcggttttagcaccagctggcaatacatcatttaaagttgtacttgttgtacttagaatacgctcacgccagattggatcttgtaaacggcgttgatattctggatcatcttctaactctttaccacgacgtaagctatatagtgataaggcaattgtacctgcaaaagtcgcaggaacagttacagaaatgatattaagtaaggttacattttcaaaccctggtaattctgtaatccgtgcaagatagaatactactgctgcagaaagtgggcttgatgtaatagctaattgcgatgcaacagaggccgcagccattggacgctcaggtcggattttattttttaatgcaatatctgcaataattggcattaccgaatatacagagtgtccagttccaagcataaatgtcatgatataggtaacaattggacctaaaagtgtgacacgttttggatttttacgcagaatacgttctgcaatttggagcatatattttaaaccgccagccgcttctaaaatagatgcacaggttacaacagctaagataattaacatgacgtccacaggtgccttacctggtggcatacgtaaaataaatacttcaacggctaaaccaattcccgaaacaacccctagaccgataccgccaaaacggctgcctacatagagaaacgctaataatagtaaaaactcaaaatagagcatacaaacctcgttaagtaataataaaacaggataaattctatctagttgaatttgaagatggaagtggtaggttttaactagatcaaatttttgttatttttataaagaattaaccctttgtttttattataaaaagaagaacagagatctttttcgtacaaaacctcttctctgtgttaaaatccccccagatcaaattatctgatctaaattcatttcccaaccgaacctacttctgaatttacatttcaataataaaaacaataagttatataattttataaagagaacaatagaatgatcgttgatccaaattaccaaaaagaactcgagaaatatgagaaccctgtgccaagcagggaatttattttacaaaccattcgtgactatgacgctccgatgagcagagaagagttgcttgaagcatttcatctttatgatgaagaacgtcaagaagcggtgcgtcgtcgtttgcgtgcgatggaaaatgatgggcagttagtctttactaagaaaaaacgttatgccttacctgaaaaaatggacttaatcaaaggcacggtgattggacaccgtgatggttacggctttttgcaagttgaaggcgatgatgactggtttattccgaatagtcagatgaaccgtgtgatgcacggtgattttgtgctggctcaaccgaatggaattgaccgtcgtgggcgtaaagaagtacggattgtacgtgtgcttgaagcacgcaaaaagcagattgttggacgttttttcactgagagtggtatcaattatgtggtgcctgatgatagtcgtatcaatcaggatattttgattcctgaagaacatcgtctaggggcgagaatggggcaagtggttgtggttgaacttcagccacgcaaagcagatttcaaacgccctgttggtgtgattacggaaattctaggggataatcttgcaccaggtatggaaatcgaaattgctctgcgtaaccacgatattccgcacgtttggccagaaggtgtggaaaaacaggtgcgtcaatttaacgaagaagtgcctgaggaagcaaaaataggtcgggttgatctgcgtgacttgccgttggtgacgattgatggcgaaagtgcgagggattttgatgatgcggtgttttgtcaaaaagagagcaacggctggcgtttgtgggtggcgattgcagatgtgagttactatgttcgcccaaaaactgcccttgatcttgaagcacaacagcgtggtaattcggtctatttccctaatcgtgtgatcccgatgttacctgaagtgctatcaaatgggttatgttcattaaatccgcaagtagatcggctctgcttagtggcagaaatggtggtgtctgaaagcggtaagttactgggttataaattctatgaagcggtgatgaactcgcacgctcgcttaacttatataaaagtgtggaacattttggaaggcgacgaagcacttcgtgagcgttatttttatcttgtgccacatttggaagagttgcacgcaatgtataagatgttgctgaatactcgtcaccaacgtggtgcgattgagtttgaaacggtggaaaatcaatttattttcaatccacaagggcgtattgaacgcattgagcctgtgatccgcaatgatgcacataaaatcattgaagagtgtatgattttagccaacattgcttctgctcgttttgtagaagaagcaaatgaaccagccttattccgtattcacgctcaaccgagtgaagagaagctcaccagtttccgtactttcttaaaagagtgtggtttatgcttaaatggcggtttgcgtccaacaccaaaagattacgccgaattgctagaacaggtcaaagaacgtcctgatgctgaattaattcagacaatgttacttcgctcgttcaaacaagcggtctattcccctgataatgaaggacattttggcttggcattgacggaatatgcccatttcacttctccgatccgtcgttatcctgatttgttattacatcgtgccattaagtatttgattgaaaaggaaaaaggcaacaagcgtcactataccgatggcggtggctatcactatcagatcgacgatatggatattttcggtgaaaaatgttctgcaacggaacgtcgagcagacgaagctacacgagaagtggctgattggctgaaatgtgaatatatgcaagatcatatcggcgaagtgtttgacggcgtgatttccagcgtaacgggatttggtttgttcgtaaaactcaatgaactgctgatcgacggtttagtccacatttcaactttagataacggctattaccatttcgacagcgaccgccagcgtcttgtcggcgaaaacggcgtaatgtaccgcttgggcgatcctgttagggttaaagtgatcggggtaaatcttgatgataaaaaaattgattttgcgttggtgaccagcttacgcaaagctcgtggtgaaggcaaaacagcgaagaaaaaagcgaaggcagaaaagcctgtgtttaaggaagttaagataaaaaatgcgagaaccaagtccataaatagaaaatcgagtaaaagtaagtattgagcgaagatgaatatgcgttttttcgacacccacacacatctagactatctcgctcaagatcttaatctgtctgtttcgcaattaatacataatgctaaagcacaacaggtggaacgaattttggttgtagcaatttctgcaaaaaattttgagcaagtcgccgcttgtagccaagctgaaccaaatcatattgtgtatggcttaggcttacatcccctttatattgccgaacatcaaacagccgatttggatttacttgaaagctatctgcaacgccaagatccgcattgcacggcaattgccgagattggcttagaacgagcggttgaagcggtttgtacgcctgagctgtggcataaacaatgtgcatttttagaagcacaattagcttttgccaagcggtatgatttgcctgtgaatttacactctcgtaaaagccacgatcagctttttacttttttgaaaaaagcacaacttgctcgaacaggtgttatacacgggtttgcgggaagttatgaacaagcgaagcgttttgttgatttaggttataaaatcggggtgggcggtacgataagctaccaaagagcaaataaaactagagaaacaatgcgtaaattacctttggaaagtttactacttgaaaccgatgcccctgatatgcctgtctttggttatcaaggcgagccgaaccgttcagagcgtttgaacgtgagttttaacgcattatgtgaattacgtcgtgaaactcctgagcagattgccgaaaccatttggcagacaagtgaaaggttattttggttaggttttcgctaacgtccatacctgaatttcctttactccctgtttgagtaactcggcacaaatcgcatttaaggttgaacctgtggtgaccacatcatctacaatcgctacccgttgataaggctgtttcggttgataaataaaagcccctcgtagatttttacgacgttcttgacctgtcagctctcgttgcggttgggtggctcgaatacgttgtaaactctctttatccattggcagatgaagccattttgctaactgttgggctaaaagcaccgcttgattgtagcctcgttgccattcacgttgccaatataacggcacgggtaaaatcacttcgggcaatgtgagctgatgtgttcgtctagcttgataaatagcaagtagtagcagtcgtgctaatggttgatcaagccaatattgctgttgaaatttgaagcggtggatccattctgcaagcggtggtttatattgggaaatttgcacgatgcgatgccatttaggttcattttttaaacaatttccacagtaattgtgatcgcttaacagaaaacttccacagccaccacagtagcagtggcgttttagcagatcattacaacggctacaaataccgtgtgatgcaatggcaagccgtctgtcgcaatgtacacagcgaaatccccagtcgttcatcttttcctcaataacttttttctttgaactctatcaagttttttaagagaagtttggggaatttttgtgacacggatcgaaaaaagagtaaaatttcacagattaaacataaaaggagatgttatgcaaaagccaactgccccaatcaaaattgtgttttttgatattgatgaaaccttatattacaaaaaagaaacccgtattccgctgtctatttcagagcaagtacttcctcgtttacgagctaaagggattatccctgcgattgccacgggtagaacttacggagcttttcctaaagcaatcaagccgttaatgaatgaaaaaggttttgatctgtttgtgacgacaaacggacaatataacctttatcgagatcaggttatcagtgaatatccgctaacaactgaacgtattgagcgtatattagccaaactgcaggcgttgcagattgagtatgcctttgtgacagcagaacaaattgctgtatctaaaaatacagcagaagtggaagagtcgttgcgcccaattaaagaagattatattgtcgatccgaatttttatttggatcactcggttattcagctattggtattctttccgcaagaacgtacagaagaagttattcgttcaggcattttagaagatgatttaaaagaagtgcgttggcataaatattcggtggatttgttaaataaaaacaactcaaaagcacgcggtattgaagatgttctcaaccattttggttttggtattgaaaatgcgatggcgtttggtgatggtctaaatgatttggaaatgattgctgccgtaggctttggggttgcaatgggcaatgcggaagatgaactgaaagctgtggcagattatgtcactttgccgattgaacaagatggcattttggtggctttagaaaagttaggggtgatttaacttgctgagagtgtttaacgaatgtaaacaaaaagagtttgtggtaataaagaaaacaattaacacgaactcttttgtctattgtgcttaactagaaatattaagctgaccttgcagagcagttaagcaatcataattttgaaaagaatttataggacggaataaccaacaagctagcaagtacagccttaataactccgccaataatgaatggatataaaccgaattcaagcactttatcgcttggtacaaaaagtgaaagttgagctagtccaaaaacgaaagtaataacagtcgcagctaatgctaccacaacacttttccagaaagattttaaaatacctttatcactaaagtatcctaataaataagctgtcggtacaaaaccaattaaatatccacctgatgggcctaataatgattgaaatccagatccaccattagcaaatactggtaaaccaatcacaccttcaaataaataaagtaatactgcagaaacagcagctttacgccccaatgcaaaaccaaccacggttaatgctagcgtctgacctgtaattggaacgggatacattggcacagaaatttgagcaaaaatcgcaataagatttgcaccaataagagatttcaaaataaaagaaagagattggtttgcctctaaccattttttagtctgagaaagttgtgttataaacatagttacttcctttaaattggaaaatggatgcagattatactagacttacactaaaaagtaactgttttagggcaataagtaagatggtaaaaccagtttgtatttatgtagatgatggggtgagtgatgtaggggtagcatctttgcaacttgcaattgctacaaatcttggtttacccacaaaaactattactgcacagcacattattgataatgagctagaacattgtcaaatgttgattatgccaggcggcgctgatctcccttattgtgcaaaattaaatggaaaagggaaccaacatattcggcagtttgtacaatgtggtggtttttatcttggaatttgtgccggtgcttattatgcaacaaagaccatcgaatttactggagatggttatcaaatttttgagaacagggaattagcgctttttaacgggaaagctgttggttcattgccggatttgactaatcagtactactatgatggaacagctgtatcaaaaacctttgcaacattaacttttcaaaataacactcaattgagcttttattatcatggaggtccaatgtttttgagtgaagtagaggatgcagagactgtggttgcttgctattctgcaaatcgcccagccattgtttgtggatcttatggtaaaggtaaattcttgctctctggtgttcactttgaattacagcccgaaatttatgagcaatatatcataagagatactctacacttatcagaatacattctagaacaatctatctataaccagattaaacaaatggatagcaattatatctggaaaaaaattagaagactgctagataaggtatctactatatgaaagaactaacaaaacttgtaaataaccacgcagagttgtttggcaattacgctattgattgctaaaatgctactttagattgcgatataaggagctgactatgaatatcccgttctgcttacctgaaaatatttctgctgaagactttttgcaaaattattggcaaaaacgaccgcttttaattcgtaatggattaccacaaattgtggggctgtttgagcctcaagacattattgaattagctcaggaaggggaagtaacttctcgtttgatccaaacacatcaaacagcagaaggtgagaaatggtcgctcaagcgtagtccgttatcggctgaagattttgaaaatttacctgagcagtggtctgtattagtgcaaaatcttgaacagtggtcgccagaacttggtgcattatggcaagcatttggctatatcccacaatggcaacgtgatgatattatgatttcttacgctcctgctggcggttctgttggcaaacactatgatgaatatgatgttttccttgtgcaaggctatgggcatcgtcgttggcagttaggcaaatggtgtgaccctagcactgaattcaaaccaaaccaacctatccgtatttttgatgatatgggcgaattgatttttgatgaggtgcttgcaccaggtgatgtactttatgtaccgtcacgcctttctcattatggcgtagcacaagatgactgcttaactttctcttttggtttacgtttccctaatgctacagatttacttgaaaacctatgtaaaaccattgaacatcaaggggaaattatcccaaattcacaatttgcaatcccattccgtttgtcgccaaatatgcaaccgaacgccttacttgatccaaaaatggttgctacattaaaagcacgtttgatcgacttattgcaaaactctactcagtttgatgaaatctttacgcatagtgttgctactgccgtgagtacgcgtcgttatgaacaattaaccgaagacaacgagttttatcctgacgaagtacaggaggtgctagaagcgggtggttgggtacaacaagatgcgaacgttaaaatcctttatactgagaacccgttacgcgtttatgtcaatggtgagtggattgatgaacttaatgaagccgaagctaatttgttaatccgtattgccaacggtgatgcgatttcgtggaataaacttgcttctaaggctgaaaatcaagatgaattagaactcttactcgatacactttgtgattggttagatagtggttgggtagtgttgatggataaaaaataatttctttctctattcatactagggactatctttattttttgttcctaagggctactttagccctctctatgtagcatacaatcaagcggttattttccacaaccattttacaatgagccaacaactattagacggtgtaccgctaaccgccctttcgggtgttggggcggcgatttcagagaaactcagtcggatcggcattaataatgtgcaagatctgctgttccatttgcctatgcgctatgaagaccgtactcggatcacgccgattgcggatgttcgtcctgaaagttttgcgacggttgaaggctttgtgcaactgacggaagtgcaatttggtcgtcgtccgattttaagtaccacaatttctgacggcacaagcaaaattaccctgaaattctttaatttcaatgcgggaatgaaaaatagtctggcaactggtgtaagagtgaaagcctttggcgagattaaacgtggtcgctttatggcagaaattcatcaccctgaatatcaaattattcggggaaatcaaccgcttgagctggcagaaacattaacaccgatttacccgacaaccgaaggcttgaagcaagcctctttgcgtaaattaaccgatcaagccttggcgttacttgagcgtgtgcaagtggcagaattgcttcctgatgaatttaatccacacaaatatagcttaaaagaagctttgcagttgttgcatcgaccgccaccgagtgtgtcgtccgaattgttagataaaggcgagcaccctgcacaaaaacggctgatttttgaagagctgttggctcataatttggcgatgcaacaggtacgaatgggtgtgcaacaacattttgcggaaccgctacgttatcaaaccgatttaaaacaacgctttttagccactttgccgtttcaaccgaccaacgctcaaagccgtgtgactacggagattgaacaggatttggcaaaaccttttccgatgatgcgactggtgcaaggcgatgtgggttcaggcaaaacccttgtggctgcgttagcggcactgttggcgattgataatggtaaacaggtggcgttaatggcaccgaccgaaattctcgccgagcaacacgctcacaattttgccaactggttgcgaccttttgggatcgaagtgggctggttagctggcaaagtgaaaggtaaagcgagaacagctcagttggaagcgattaaaaacggcgatgttcagatgattatcggcacgcacgccctgtttcaagatcaggtggaatttcatcatcttgctcttgtgattattgatgaacagcaccgctttggtgtacatcagcgtttaaccctacgcgagaaaggggcgaagggcgatgtctatcctcaccagttgattatgaccgcaacgcctattccacgcaccttggcgatgaccgtctatgcggatttggatacgtccattattgacgaacttcccccagggcgaacgccgatcacgacggtggcgatttcggaagatcgccgagatgaagtggttcgccgtgtttatcaagcctgtaaaaatgaaaaacgccaagcctattgggtctgtacgctaattgatgagtcggaagtgttagaagcacaagcggcggcagccattgcagaagatttgcaacgtgctttgccagatttgcggattgggttggttcacgggcgaatgaaaccacaggaaaaacaggcaattatggcggaatttaaggcggcaaatattgatttgttggtggcaacaacggtgattgaagtcggtgtagatgtgccgaatgccagtttgatgattatcgaaaattccgaacgcttgggattggcacagctgcaccaactgcgtgggcgtgttggacgaggagcgacggcttcccattgtgtcttgatgtacaaagccccattgggtaaaatttcatctaaacggttacaggtactgagagatagccaagacggttttgtgattgctgaaaaagatttggaaattcgtggtccgggtgaagtgttaggcacaaaacagacaggtatggcggagttcaaaattgcgaatttaatgcgagatcgcaagatgatcccattggtgcagaactacgccaaacagctgacgttaaaatatcctgatacggctaaacagctaattcgccgttggcttgatgaaaagacggtttatagtaatgcgtaacttgattttattctatttattcaatactaaaactttatttttctccctttattgggcctcaaaaaggcaatagtagtcttcttccagtacttttgtatatcatttttctaatcgattccaattcacaatgtaaatagagattagatatctttattatcaataaagatataaaaaatttttttcttcttaagaattttttaagatttacttgctttaatactctcaacgaaaggcaagaaccttcgttattcatacttattattttaattattcggagtattctatgaaaaaagcaattatcttaacgacattattagcggtttctactgtatcaatggcaaagggcgatggtgatcgtgatcgtcacggtggctatcacgatggtaaagcaagaacacatcaatcacaagatttctttgatgaaagtcttgcagtgaaaagcgtagcagatgcacttaaagcaactgatgacacccctgtactacttgaaggacaaatcgttaaacaaatcgacaaaggcgagtttatctttaaagataaaacaggcgaaatcgaaattgatgtaagtaaacgtgcttggaatggtttaaatatcggtcctcaagataccattcaaattcgtggtaaagttgataaagattggaacaaagttcaagtggatgtaaaacagattaccaagaaataatttattctcactagcggtctgtttttgcaaataatttgagcctctcccacaatttgtgtaaatacctgtttctgagataatacattcagacacaggtattttattatgaacgaaaaacaacttcacgccttggcagcggaatttgccaaaaccctcaacacaccggaagacctaatccgttttcacgcatgcttaaaaaatcacggttgaagccgctttaaatagcgaactcactgaccatcttggcgatgaaaagcatcagcctagaaaaggtaaaaatgcacgtaacggttacacatctaagaccgtcatttgtgatgaaggtgagatagaaattgagacgcctcgtgaccgtgacggcacctttgaaccgcaacttatcaagaaaaaccaaacccgcatcacaggaatggatgagcagattattgccttatatgccaaagggttaagtaatcaggaaatcgttgaaatgttcaaagaactctatgatgcggatgtatcaaccagcctgatttctcgcgttaccgacgccgtgaaagagcacgtaatattgccacattttttgattatccggctgatattcgtaaagcgatttataccacgaatgccgtggaatcgcttaatagcgtgattcgtcgcgtgattaaaaaacgaaatgtattcccgacggatgattcagttttcaaagtgatttggcttgcgattaaagaagcatcaaaaaaatggacaatgccgattcagaactggaaactggcgatgaatcgatttatgattgattttggtgatcgcctagacgatcaccgttaagttgaaatgggtgtttacacagaatttgggatagggtcttttattttctgaacctaacttttaagactaagcgtaatacatctcaaattccacaggatgtggggtcatattcaaacgctcaacttctttacgtttcattgcaatgaaagcatcgataaattctttagtgaacacgccgccttgggttaaaaattcataatctttttccaagttatctaacgcttcacctaatgaacttgatactgcagggatctcttttaattcttctggcggtaagtcatagaggtttttatccattgcatcgcctgggtggattttgttaatcacaccatcaagaccagccattaataacgccgcaaaacataagtatgggtttgccattggatctgggaaacgtgcttcaacacgcgttgctttcgggctagttaccgcaggaatacggatagatgcagagcggttacttgcagaataagctaataatacaggtgcttcaaagcctggtactaaacgtttgtatgagtttgttgttgggttagtaaacgcatttaatgctttagcgtgtttgatgataccaccgatatagtaaagggcagtttcagacaagcctgcatatttatcgcccataaagacgtttttaccatctttgcttaacgacatattacagtgcatacctgagccgttatcacctgcaaatggttttggcataaagcaagcggttttaccgtgttcaagggcaacgttttgaaccacatatttatagatttgggtttcatctgcttttaaagttaaactattgaaacggcttgcaatttcattttgacctgctgtcgccacttcgtgatggtgagcttcaatcactaagcccatctcttctaaaatcaagcacatctcagaacgaatatcgtgagcggtgtcgattggcgctactgcacagtaaccgccttttttgagtggacgatacgcattattgccatcttcatatttacggttagtattccacgccgcttcaatatcatcaatatgataagacacattgttcatctctgtgctaaaacgaacatcatcaaaaaggaagaactccggctctggaccaaacattacgctatcagcaatgcctgttgattttaggtagttttcagcacgaatagcaattgaacgtgggtcacggtcatagctttgcattgtgtttgggtcgaagatgctacagcggatagtgagggttgggatacgggcgaaagggtctacaacggcggtttcaggaattggcattaacagcatatcggctttgttaatcgctcgccaaccttcaaccgaggatccgtcaaacattcgcccctcttcaaaaaggtcttcgaggtcgtctgcgacaagggaaactggcattgataccccgtgttctttacctttaatgtcggtaaatttcagtaagacaaatttaatatcattctctcgaatgagttttgcaacgtttgcaatagcgttggtgtttgacattggctaatcctcttaaaataataactacaaataaaaaagtgtctgagacgctgtttaaaataccataagaaaaagaaatatcaataaaaatttttatgaccttcattattttttctaatatctttgtttgcaaaacaactttgttctctatcgacactatattgtgattaaaaatgctcgtcaatgtatttcaatagagagataaaattaacgctatacctaacaaatcgcagccgctcgactcgttaagtacaaatatcaaaccgcattgtcattcacaaactgccagttaagaaaaactccaacatagtagtttaagttacattgaaaataataagagcgcctcaatctcctcgcgtctaggaattgctgtctgtgcccccattcttgtgaccgaaattgccgctgctgcgtgagcaaaacgaatagattctttaggtgattttccttctaataatgccgtcacaaaagctccgttaaatgtatcgcctgcggctgttgtatccactgcatcgacaaggaaccctggaataatttcaccttgtcctttttcgctataaaacaaaccttttgagcctagggtaattaagaccgtttcgatcccaagttgatgaaaatagttggcggctacagctgcagtttgctcattggtcactttaattccagtcagtatttccgcttctgtttcatttggggtgataatgtcaatttgtgataataaactgtccggtaaaggttgagcgggagcgggatttaacaccacttttacccctgcttttttggcaatttttgcagccttagccaccgcttgtaacggactttccaactgcattagcaaaatatccgcttgttcaatatgtgatttatgttgttcaactaaagcctctgaaagatccgcatttgcgccagcggaaatcacaatactgttttcacccaaatcggcaacctgaatcatcgctaaccctgttgattggttttcaataacagaaattgcttctgtattgatcccgtcttgttcaaaggcttgcttcattgttttcccaatttgatcattaccaattgcaccaataaagtgtacatttgcaccacatcttgccgctgcaaccgcttgatttgccccttttccaccataagcaatttgataaccgtaacctgttaaggtttcacctgctttggggaagtaaggtactcgaataacgtgatcgacattgatactaccgagaacacagagttttttcataactactcctaaatatagaggcgaaacatctttcgcctccaatatgaaaatagggcaaatatcatttgctcctacagataaactatttagaaatgacttttaatggaaccggaatttgtgcttcaactttttcacctttcaacactttatccgctacttcaacacctaactcaccgattttttctggttgttgagcaatagttgccgcaagttgtccgccattaactgcttttaccgcatcatctgtaccatcaaaaccaacgactaaaatatttttgcctgaagctctaattgcacgcaacgcccctaatgccatctcatcattttgagcaaatactgctttagcagaaccatggctggcaagcaagttttccatcacatttaaacctttagtacggtcaaaatctgctggctggctagcaagtagttcaaattggttggcttctatcgcttgtttaaaaccttctccacgctcacgcgcagcagaggtgccagcaatgccttctaattgaattacttttgcatttttaccaactttttcagcgataaaatcaccagccatttttccacctgctacgttatcggaggcaatatggcttactacattgcctttatttgcaccacggtctaaggtgatgactggaatatttttcttattggctaccgcaacggctgtacctaccgcttcagaatcggttgggttaattaataatactgttgcaccacgaacagtcacatcttcaacgttagacagctctttcgctgggtcattttgtgaatccaaaacaactaagttatagcctaattctttggcttttttctctgcaccttctttcaaggtcacaaagaatggattatctaaggttgaaattgccagagcgatagtttcttttgccattgctgatgtactgaatgctaaacctaatgcaatcgctaatgaagttaattttttcataaaaatctcctatgtgatgaagaataatctcttagagcagctacacttttttacgacctatgaagttatctaagataaccgcagctaagattaccagcgctttcgcaactagttgatagtaagagtcaatgtctaataaattcaaggcattgctcaagaaaccgataattaatgcaccgattaatgtgccgataatacgacctttaccgcccataagactggtaccacccactacaacagccgctatcgcatctaattcatagcctgttcctgcggttggttgggcagagcctaaacgagaggtgatgatcaaaccagcaagggcagccaatacaccgctgacagcaaacacaaagagtttaactttatttacattaatacctgaaagtgcggttgccgattcatttccccctaaggcataaatataacgccccatacgcgtctgggtcagaacaaaccaacctaatgcaaataaggcaaacatcagccaaataggaactggaataccgagccaaatccctgtgccgatttcggcgaaagcatcagcattatcggaaaaacctgtgctaatcgggcgaccgcccatataaatcatcgttacaccacgcaataacagcatcgtaatcaaagttgccataaaggcttgaactttaccaaatgccaccagcgatccattaagtaaaccgattaaacaaccaaaaatcagtacggtgggaatcacgacataaacgggtaaatctattccaactaatgttgcagccacagctcccgtcagagcaagtactgaaccaacagataaatcaataccagcaatcaaaatcacaaaggtcataccaatcgcaataatggcgttcacagaggtttgacgcaaaatgttgagcaagttatctgtggtaaaaaaatccggatttaaaaatgacaccacaacaatcagggtgattaacgcaataatcgaccgctgttcaattaaaaattttgttaagttaaacgatttattcatttgcaaatttcctatgagatctggccgcttgttttaccaattgctgctgctaataatttttcttgagtcgcttcttgacggctaaattcaccgctgattcgaccttctcgcatcactaaaatacggtcggacattcctaaaacttctggcatatcggacgatactaaaataatactaagcccttccgctttaaatttattgataagttgatagatttctttttttgctccaacatctacgcctcttgttggttcatctaaaatcagcacattcggacgagtcattaatcctttggcaatcgccactttttgctgatttcccccagataactcaccaataattttatcggaattggggggtttaatattaaacagttcaataaaatccgtgacgaccatattctctctagctttatcaattcttccgtaatgagaaagatgagctaatgcggtcaaagacatattctccttcaccgacatacctagcactaaaccatcacccttacgatcttcggaaatatagacaatgccgttatctaatccttcttgagcggtatggttatgaatgtctttgccatctaatctgactgaacccgatgtacgaggcaatgcaccgtaaagcactttcatcaactcagttcgccctgcgcccattaacccagaaacccgagaatttcgcctttttttaggctgaatgagatttgatgaacaccgcttcccgtcaaattattgacttcaaagcgcacactgtcttgatcggtctcgatatgcggatattgttcttccaattttcgtccgaccatcatttcaatcaactgatcttcatttaaatcggcaatagctttttcaccaataaattgcccatcacgcaagacagtcacatcatcgcaaatttggaaaatttctttaatacgatgggaaatatagacgatgcctcgaccttccgctttcaactcacgaatcaccgcaaataaagcttcggtttccgtatccgtcagcgcatccgttggttcatccatcacaatcactttagattcaaaactcaaggctttagcaatctctaccatttgccgttcaccgatagaaagttcgccggcaggtaagcggctagagtgggtgacaccgagtcgggctaacaagcggtcggattctgcatacattttacgccaatcaataccaccccaagggtgcgtaaattcacgtcctaaaaagatgttttcagcaatggagagattaccgagtatatttagctcttggtgaataatactcaacccagcttcttgagaggctttcggattagcaaatttcacaacttgtccaagatattcaatcgtgccagcatcacgttgataaattcctgtcagaattttcattaaggttgatttacctgctccattctcacccattaacgccatcgctctacccgcatagacattcaagcaagcatttttaagagcctgaacaccgggaaaggctttatcaattccgctaattttgagtaaggtcttcatcatatccacctaaaatggtacgcccgaataaagaataacattcgcatacgggctacattctcccgttctaacgacggctttggcttgattactttgatgtttaaattcgttatgtgggatatattcaatcttaatggtatttttttgttgcacctctatttgttggataaccattaataactgttgttcaatttgaggattaatattcttgatttcttcagctaatacaattttttcaataaataattcacttaataccgcttgtaagactgaaagaaaatcggggatacctttggttaaagcaaggtcaatgcaatgctgctctgttggaattggtaaaccagaatcacaaattgtgagtccatcggtatgtcccattgttgcaattacatgtgaaagttgagcatttaagattgttgtctttttcatcacaaaccgtcctttaaaaaccatcgaaacgtttcgataaaaaataaatcaaaaatagcgaaaaggcaatcgacttatcttgaaactgtgatgtacttcaaaaaataacgttaaaaggattctcgaataatcaattcgggcgtcagttttatcgtttctatttccgtttgtggctgatgaatgcgtaaaattaatttctcaaccgcggctttcgctagtcgtgctttgggttgatgaatggtggaaagtggaggataaagatattgagccagttcaatattatcgtaaccgataatcgcaatatcttgtggaatacgcaatcctgcacgttgaatgacttgatacgcaccaatcgcaatgctatcactcatagcaaaaaccgcacgtgggcgattttccagcgccaacagtttagtcatcgcctcgacaccaccgtcataatggaaatggctttcaataatccattcggggcgaatttgcaaattattctctaaaagtacccgcttgtagccagctaaacgattttgagccaaaggttttgaaagttcaccagtaataatggctatatcgtgataaccagcatcgataaacgcttttgtcgcaagatacccgcctaatactgaattttcgtgaataatatcggcattgagcgactgttgccaccagtcaatcactaccataggcaatgttaaatttgtcatcgcacttaagtcaaaattttgtggctctgcacacatcagcaatagaccatcaacttgttttaataacaatctctctagatgttgctgtaaattttgactgttgccgtcggtattgactaaaatcagatggtaatgatggcgttcacaataacgttcgacatggcgaaccacttcggcaaaaaaggggttattgctagtcgtcacaatcataccaatggtattggtttccttgatctttaagcttcttgccaccaatgaaggacggtaattaagctcttcaatcacttttttgactttcaaggtaatttcttcactgacaaagcgcgaattatttaccacatgagaaacggttgaaagtgaaacacctgcaatgcgagcaatgtctttcattgttgccatattaatttcccctcattctcatcaaaatcatttttttattatgtcagaatttacgaaatgatgtgagtatttgtcattatgataaatagcactccttttattttgtaaaataattgtgattaatttcacattttttttaacaaaactcttgagatatcattttaaaagcgtatttttcaccctaatacacaaattataaaccatcggtttatctggtaaaccagttatgacaacacaaaatacgattagcagtgtgacggaaacactcaaacttttaaatattgttgcaaaacatcctaatacagggctcagcgaattagctcggctggctgaattaaataagtctagaacatttagaattctttgcaccttagccgaacagcattttgtctatcaagcaaaagacggatcttatcaactcggtcatcaactcttagttttagggcaagctgcacatcatcagctttctctcattcaagcggttgagcaaacgagcgaaaaattaagagcactgtttaatgaaaatttgcaattacgtgtcattgaaaataatgaagtggtacaaatttggcgcaaagtttctagtcagtcactacaagtacgtagtgtggtgggaaatcgacgccctttaggcgcaggcgcagcaggtaaattattattaacctttgcagaatcttctataagagaacgttttttggaaacctgttcccaagctcaaattcaacaatggaatatggattttactcaaatacagcaatctgaagtttccatttcaaaaggtgaattaactcaaggggtttatgctgtggctgtaccgatttttaatgcgcaaggagaatgtatcgccagttttagtatgagtattcctaatgtcagagcggaaaatgaaagattagaacagattatttttgaaatgaaacaagcctcaatatgccacagatatctatttacccactcatctaaatcaaagcgcttttcctgtcgtgattgagcgaacaccctacaataaatctgcccattcacgttcagaaatagaattagacggacgtaaaatcagtagacaagaaatggcggaagcttttacacaacgaggttttgccttaatttttcaagattgtcgcgggcgctatctctcagaaggagaatttattaagtatgtgagagaaggtgaagatggctttgatacttatcaatggataatgcagcagccttggtgtaatggcagtattggcagtatggggctctcttatgctgctcatacgcaacttgcagttgcgtgcttaaatcctgaaggattgaaaaccatggtgttggattcaggcggatttgcaaattcctatcaatgcggtattcgtcaaggtggtgcttttgaactgaaacaagcaacttgggcgtttaaacaagcagccctcagtcctatagccaaaaataatccgttgatcgccaatgcaatgacccaagaagatattcatcaatggtttacccaaatgccttggaaggcggggcactctccaattcgtcatgtgcctgaatatgaagattatttattggaacagtggcaagcgggcacatttaacgaatattggcaacaacttggtatttatgcggaaggttggtacaaaaccttacccgatattcctgtcttatttatgtccagttggtatgatgcctatgtgccatccactctcgctaactttcaagctttctgtgccttaggcagaacagcaccccaaaaattgattatgggatcatggttacacggtgatcgcaatattactcacagtggcgatgtagaatttggtttagcctctacttttgatggtaatgtggatacaaactggctggagtgccgtctgaaatggtttgaacaacatcttaaaccaaactcaccacgctcacctcaacatcagatttcattctttatgatggggggaggctcaggcaaaaaagatgaacaagggaaaatgcaacatggcggtgagtggatttatagtacagcatacccattcccagaatctacgtcacaaaaatggtatttgcagaaagatatgcgcttacgccaatctctctctgaaccggcaattcatcgctttcaatcggatcctaacaacccagtaccgactattggcggagcaattacatcgggtaaacctgtttttgttggtggtgcatttgatcagcgtgagttacccgatttctttggttctaaacaaaataacctgcccctttctgcacggcatgatgttttagtgtatcaaactgatattttggaagaagatattacccttgtgggtgaagttaaagtcaagttatttattgatagcgatgcacctgatgctgactttacggcaaaattaattgatgtttacccgccgaatgaagattacccgcaaggctatgcaatgaatatcactgatggcattctacgcgctcgttatcgagagtcttggagagagccaaaattactcaaacaaggtgaaattgttaaagttaccatccgtccatttgaaagttgcaatattttcaaaaaaggtcaccgattgcgtttagacattgcaggaagtaatttccctcactttgattgcaacccaaatagtggagagccagaaggattcgcatcagtcaaacgtatagcaaccaaccaaatacatattggggcgcaatatccatctgtattagaaatacaggttataccaaataaatagaaggtagttatcagggtaattttgcaaaaaataggcaaaatcagaccgcttgtaaaaatgattttacccataacaacacaataaaaaaacctagtatcttcatactaggtttttacaattaaatattaacgtctattcgctaattttgtttttgtgagttcgtaaacacgcagtttcgcaatttctcttgacaatttagcggttaaatctgcttcatttgtcttactcattgtttcttctgctttgcgttttgctgcaagaatacgttgttcatcgagttcttcaccacgaattgcaacgtctgcaagcacagtaacaacggttggttgaacttcaaggaatccgcctgaaacatagatgaactcttctttgttatcttccaaagtaaatttcaccatacctggtttaatagcggttaatagtggggtgtgtcctgcatagacacctaattccccatctacccctgaaactcgaacactcgttacttgaccttcaaagattttacgctctgcactaacgactgtgagttcaaatgatgtcattttgttctcctttgttcaaagaacaattacatcttgttggctctttcaaccacttcgtcaattgaacctgccatatagaacgcttgttctgggatatggtcatattcgcctgctaaaatgcctttaaagccacggattgtttcttttaatggtacaaatttgcctggtacactgttgaacacttctgccacgtggaatggttgtgataagaaacgttcaattttacgtgcacgagcaaccactaatttgtcatcttctgataactcatccataccaagaattgcgatgatgtctttcaactctttataacgttgaagcgttttttgtacgccacgtgcaacatcatagtgctcttgaccaacaacaagagggtctaattgacgtgatgttgaatcaagcggatcgatcgctgggtaaatacccaatgatgcgatattacggcttaatacaaccgttgagtctaagtgagcaaaggttgttgctggtgatgggtctgttaagtcatccgcaggaacgtaaaccgcttgaaccgaggtgatagaacctgttttggttgaagtaatacgttcttgtagtacacccatttcttctgcaagcgttggttggtaacctactgcagatggcatacgacctaataacgctgatacttctgtacctgcaagggtataacgataaatattatctacgaagaataatacgtcacgaccttcatcacggaatttttccgccatggttaaaccggttaacgcaacacgtaaacggttacctggtggctcattcatctgaccataaaccagtgatactttgtctaatacgttagagtctttcatctcgtggtagaagtcgttaccttcacgagtacgctcaccaacacctgcgaacacagagtaacctgagtgttcgattgcgatgttacggattaactccatcatatttaccgttttacctacgccagcaccaccgaataaaccaactttaccccctttagcaaacggtgcgatcaagtcgataactttgatccctgtttctaaaagttctgtgctgttagcttgatcttcataacttggtgctgcacgatgaatcgtccagcgctcttcttcaccgatagggcctgcttcatcaataggctcacctaatacgttcataatacgaccaagtgtttttgtacccactggtacttcaatcgctttattcgtattttcaacttttaagccacgttttaaaccatcagatgtaccaagagcgatacagcgtactacgccaccgcctaattgttgttgaacttcaagggttaaacctgtttcaacttttaatgcatcataaacttttggtactgcatcttgtggaaactcaacatcgattaccgcaccgatgatttgtacaatttttcccgttgccattaccgttcctctattcattgttaaattgctgcggcacccgcgacaatttcatttaattcattcgtaatacttgcttgacgagctttgttatacaccaactgtaactcattgattaaattacctgcgttatccgttgctgctttcattgccaccattcgagctgcttgttcagaagcaagattatctacaatcgcttgataaacttgagattctaaatagcgtacaagtaagctatctagcaacacttttggattcggttcatagatataatcccatgagcctttattttccaaatcatcattttcaagttcgggtaatggaagcaatttttgcatcgttggtttttgtgacatagtattcacaaaacggttataaacaatataaacttcatccacttcgccattgcgataagcttcaatcataccgttaacaataccaactaaatcttccattgcaggagtatcgcctaagcccgtaacttgagctttgacgtctaatcccattgattggaaaaacgaaaccgctttatttccaaccaatcctaagcgagcatcaattcctttatctttacgtgtttttaattcatttaaaactgttttaaataaattaatgtttaagccaccgcatagaccacggtctgttgaaaccactaaaaaaccaacttttttgacttcacgttcagttaagaaaggatgtttataatcaatacttcctttggcaatatggctaattaccttacgaatggcatctgagtatggacgtgatgcagacattctttcttgcgttttacgcattttagatgcagcaaccatctccatcgctttggtaattttttgtgtattacgaacacttgcaattttggttcttatctctttagcacctgccatattctttctccgctaaagtagattaccaagcactattctttttgaaactatctaaaatctcgattaatttcgctttgatagtgtcattgaaatcgcctgatttacttaaatctttcataaactcagcataatttgcatttgcataagctaaaagatttgattcaaatgaacctacacgctcaacttcaacatcatctaaataaccaaattcagctgctgcaagtgataaacctaattgtgccacagacattggttcaaattgtttctgtttaagtaactctgttactttttgaccgtgtgaaagttgcttacgtgttgcatcatcaagatctgaagcaaactgcgcaaaggctgctaattcacggtactgagcaagtgcagtacggataccacccgctaatttcttaacaagtttagtttgtgcagaaccaccaacacgagatacagaaataccagggtttactgctggacgaatacctgcgttaaagaagctggtttctaagaagatctgaccatcggtaatcgaaattacgtttgttggaacgaatgctgaaacgtcacctgcttgggtttcaataattggtaatgcggttaaagaaccagtttgaccttttactgcaccattggtgaaacgttctacataatctgcatttacacgcgcagcacgctcaagtaaacgagagtgtaggtagaatacgtcacctgggtaggcttcacgacctggtggacgacgtaataacaatgaaatttgacggtaagcaactgcttgcttagataaatcatcgtaaacgattaacgcatcttcaccacggtcacggaaatattcacccatcgcacaacctgcataaggtgctaaatattgtaatgcagcagattctgatgcacttgctactaccacgatagtattttgtaatgcaccatgctcttctaatttacgtaccacgtttgaaattgtagatgctttttgaccgatagccacatagatacatttaatacctgaatcacgttggttaatgatcgcatcaatcgctaatgctgttttacctgtttgacggtcaccgatgattaactcacgctgaccacgaccgattggcaccattgagtcaacggctttataaccagtttgaacaggttgatcaacagattgacggtcgataacgcccggtgcaatcacttcgataggagagaaaccgtcattgtcgatttcacctttaccatcgattggctgacctaatgtgtttactacacgacctaataaaccacgaccaacaggtacttctaaaatacggccagtacatttcacttccataccttctgctaaatctgcgtatggacccattactactgcaccaactgaatctctttctaagtttaaagcaatcgcataacgattgcctggtaatgcaatcatctcaccttgcattacatcagcgagaccgtggatacgaataaccccgtcgctgactgaaacgattgtaccagtactttgtgcttcactgaccacattgaactgtgcaatacgttttttaatcaattcactaatttctgtagaatttagttgcattttctattcctcttacaagcacaactcttggctcaaacgatttaactgaccacgactactaccatcaatgacaatatcatcgtaacgaataataacgcctgcaattaatgacgcatcgatacttgtcgtaattcgaacttcactatttagcttttgtttcatcgcgttagcgattttatcttcctgtgcttttgttaaaggtgttgctgatgtaacaaacacatctttaacggattcatactccgcacggatttgattaaaactagcaaatactgaaggtaacgccgaaagacgcttattctcagccatgactcgaatgaaattttgcccatattgatcgagttgatcaccgcaaattgcgataaaggtatcgacaacttgagtggctgcagaagatgaatgaataaaatgttgcacatcttcattttcagcaaccaatgcagaaaactgtaacatttcctgccatttatctaactgaccttgttctaaagcaaaatcaaaagctgctttagcataggggcgagctactgttgttaattgtgacatctgccccccttaattataattctgcaactagcttatcaatgatgtcattgtttgccgctgcatcaacagaacgacccacaattttctctgcaccagcaaccgccaatgcagctactttttgacgaagttcttcttgaacacggcgacgctcattttccacttctgcgtaaccttgctcaataattttcgctttctctgcttcagcttctgcttgaacagattctaaaatttcattgcgacgttttgttgctaaatcaatgatatgttgcgcttcttcacgagctttagcgagctcttgctcaactaaaactttagtatcagcttgttcttgcttcgcgttctcagcacttgcaagagcgtctgcaatatttgcttgacgcgtttcaatcgctttaataagcggtggccatacaaacttcatacagaaccacacaaacagtgcgaatgcaatcagttggcctattagtgttgcatttaagttcacaacgccctccttaagtcggctaagttactcttgagtaactacggttaaaaacaaatccgacttatttcaataaatcaatgaacgggtttgcgaagatgaaaagtaaagaaatacctactgcaatcattgcaatcgcatcaagaagacctgcaacgataaacattttagtttgtaagctgcttgctaattctggttgacgagcagaagactctaagaatttaccacctaagatagcgaagccaattgcagtacctaatgctgcgaaagcaagtaggattgatgcaccaataatagttgctgtaattacagtttccataatgttctccataaaagtaaggaaagtagccttacggctagggttaataaaaaagtttcaataaatatgatcgggtttcacaagcggtctaatctttgcaaaattttgcataaaagtgaccgctcaccaatccagtttgtttagtgatccgctttattataagcaatactcaagtaaacaatcgttagcatcataaagataaaggcttgtaacgtaataaccaaaatatggaaaatcgcccaagctaagtgtaacggcaaacctaatgcttgaagcaagaagttatccgccatatacattactgcaatcaggataaaaattaactcacctgcatacatattaccgaataaacggaatgcaagagaaatcggtttcgccaataacgttacgatctcaagtacaaagtttacaggaataaatgcccagtggttaaatgggtgaagcgtatattctttaacaaaaccagaaaaacctttcgatttaatggtgtaaaaaataattaaacagaacacacaaatcgccatacctaaggttgcactaatgtctgctgttggaacagcacgcaaatagtcaatccctaataactctgcaaattgtggtggataatccacaggaattaagtcgatagcattcatcacgaacacccagcagaacacagttaaagctaaaggtgcaaccacctcacgactaccgtggaagttatctttaaccaaaccatcaacccactcgacaatcatttcaacaaaacattgaaatttacctggtacgccatctgttgcattcttcgccacacgagagaagaaaaagaggaaaattgcacctgctactaatgagaaaaacagagtatctaaatgcacattccaaaaaccgtcccctgttttcaagaacgataagtggtgaccaatatagtcagccgttgtttgaccagccatagtttatccttttgaaattaaaagaaatttattttgaatgccacttcaatgcaataggcaaaagactattacaaagaatcataaaaaagaacccacaaaaaaacgaaacatagtgcatagcaccataacttttaaacgccaccacaatcacaatgatcgtcgtaagccatttcagcccttccccacgataaaaagcggtcatattttgaggatttattaccgatttacgaaaaaacacccaatacacaaacacacaatgtggaagcaatgccgcaatttcccctaataataacgaaataaagcgatttaagcctaacccaatccccactgctccagctatgcagaacagtagaattaactctataccgagtgctttttgataaagttgtttcgtttgtcgaaaaaccgcagacatttttgactaaaacctaataaaaaagtaaacgatttctttgtgtaaactaatctaaagttacgcaatcaaaatcttccgaattatacgcagattgaccaaaattgccaacctgtaaaccctgcaaaaatgtcggttacttaacatttttataaaaaaaatggggttgtcctagataactaacttaagctgcccttaactaattgttttaaaatggaaatttgagattttaagttaccgtgattaaaacgccattcgcattccttcaaatacaactcaaaatgtgctttgggaataccgttaaacttgcgtaaatgatgtttagcttagttccaaaaattctcaattccgtttacatgattttgtttttctgcgaaatgagtactgtgattgatacgaaaatgattaaactcactcacatcaagaacatcataacttcgataaaaatcggtgtaaacaatgctgtcaggcttcaccttttctcgaataatcggtaaaagtgtcgcagattgaatattcggtacaacgacggtatacaccttaccatcacactttaaaagcccgaatacagcggttttactcacagctccacgacctcgtttacctttgcgagtgccgccaaaatagctttcatcggcttcaatttcaccttcaaacatctccatatgtgggctgttttgatagataagcaatcgcagacgatagaagtaataggctgctgtcgttttatttacatttaccaactcagctgttgttcgagcagtgacacctgccacaaacagctcaatgagtttattttgtttatgctgacttagacgactttttctcatttggttattttaacctaaaatagagcttttagtcgttatctaggacagccccaaaaaattaacattcttatgcttttagaaataaatatccctgatattatttgcgacataatgtattttcatatgctattaagaaaaagttaataattttgttggtaaaagcccaaagggctcttgtgaacacttcaatataaccaattaaattctagagagagcacctaatagagatatgccaaattttttagcggaatttgagaaaactccctgttaattttctgaaaatcggtataatcaaactgttgttcaacttccttgataatgcttatgcaaccgatactttattccctccctgattttctcttatcgccactgttttgggtgtttgccttattggtatttgcaatttggcagttcattcgcaataaattacgaatggatattgttgccttactcgttattgccttttttagtctaagtggcattctttcggtcaatgaagtgtttgctggattaagtgatccgaatgtgattttgattgctttgctctttattgtgggcgaggggcttgtaagaacagggattgcctatcaggtgagtgagtggctaatgcgtgttgcaggggcaagcgaagttaaggttttagtgttgttgatgttatctattgctgggcttggctcttttatgagttcaacggggattgtggctatttttattcctgtggtgttggcaatttgttcgggtatggggatttctccgaaacgcttaatgatgccactgagttttgctgggcttattagcggtatgatgaccttaattgcgacaccacccaaccttgtggctaactctgaattagttaaagcaggacatcaaggttttggtttcttcagttttacaccgattggcgtttcggtcttggtgctggggattgtttatatgctttttgctcgccgttggttagataatggcgaaacagtccgcactgaaaataaaaatggttcatcaatgcaacagcttattgcggaatataatttaactgggcgagcgaaaatggtagtaatcgatgctggctcatcattgattggaaaaacgatcaatgaattaaatctccgccgtgagtatcggctaaatatcgtggctattcaacgtgttaaacgtttaagaacactttctattgccgcctatggcacggaaactttgcaagaaaaagatattctgttgatggatattaacattgatttagaccgttttctgcaacagtgtgaggactttggtttacgcaccattgagttgaaaggggactatttctcagaacacgcaaaatccgttggaatggcagaattttcgattatgcctgaggcagaaagtatcggaaaaagtattagtgaactcaaattccgttctacctatggcttaagtgtcgtcggattaaaacgaggggatacattgattgaagataatcttatttctaccccattagaatttggagacaccttgctgattatgggggtatggaataatttgctcaaactcgatcacaataaccgtgatttcttcttactcaaagcccccgaagagagcaagcacgcagcgccagcgattagccaagcaccccacgccattttttcgattgtcacaatggtggtattgatgatcacagggttagtgccaaatgtgattgcggctttgattgcctgtttgatgttaggtaaattccgttgtgtcgatatgaaaagtgcttatgagtcaatccattggccgagtattgtcttaattgtcggtatgatgccattttccattgcattacaaaaaacaggtgggatcgatctgattgttcaaatgcttactgagattatgcaaggtttaggggttcattttgtgttgatggtgttatttatttttaccgctatcatcaatgcctttatctcaaatacagccactgcaattttagtaatgccgattgccattgctatcgcacaacagctaaatttttcgccagtaccatttgcaatgattgtcgctatttcagcctcagcctcttttattacccccgtttcatctcctgtgaatacgatggtacttgcaccaagtggctatagttttatggactttgtgaaagtaggattaccgtttacgcttttggtaatgctgttagcggtctttttggtgccaatgttatttccgctttgattattttatattcattgtttgatcttctaatgatttacgcaccccaagacggcgaccatcaatggttgggcggataccaatttttactggagttgatttgagttgagtcataaaaatccccttaattaactggttaaactgacgaggatattttgctacttattgacgatgaaaaaagaatttttacgaaatttgtgcagattttgtgaattgcctcacaaaaagccagccctaagcggtaagattgagtgatttttttacaatttacttgcccgatttggcgatagaaaggggaaaatcgggcagttattcaaaaacaaatagagacatttatagatgcctcaagaggttacaatttaatcttcagacactttatcacgcccaatctgaaaaccatacatatctatgattttggcttttgaatagcgataatttgttggctttccatcaaaatcaagaatttggtggcttttactcaacgtatcaatttcttctttattttcttgataaaactgggcaattatatttagagatgtttcattaggggtactaaaaccacactcctccctcgctatttcactaaaagtgtccttaaagaaacgatcataggcaggaataatagcaaacacacctaataacactttagtcactaaagtcaccgcttgatgctttttctcgccaataagatgtgattttacctgagtatataaagataaaacttcctttgtcttattagggtaatcttcaacatcaataagccaagtcgcttgtggttgttcatagatccatttaacgagttctgttaaataggcaggatttctctgcattaagaaactagagcctctcaacattccccaacttgctaaatagctccataatacaaaacaacttttttcgatatccatatgtcctgtttctttagaatggcggaaatgtacataacagaaatcaaagctgtaatagcgatgttttatatcttttgattcatcatcaaattgtttgataactctactaatgtctcttttcataaattctgcctctgcttctcttcatataaatcaatattgtctgatttagtttttagtaattaaagatagatcaattatgcctagtacgaaaaattcgcactaggctactcaatgaacatcgtttaactcgggtaatccctacagtttctacttaacttatatcaagccaaaataacgtaatagcaatacaattataattaatggcgttagttttataattaatggtattaatttcactacctattcaatcaagtcaaaaatgtcagggttcttgttttttttacgggccattttaatatccttatatgattgataatttagttgccttaaaaggcttaattagcattctaaaatgctgttcaacagtattttaaaaatttagaatatctcaaagttaaatttaccaagaagataccaaagcccgcctgcgcaaagtaaaattacagtcagaaataagccaagctcaggttcgtttgaagggttatctttataccttttatccgccttaccgctcttggttttatgcgttggagcaaatgatacaaacataagaaaaacagataaaccaaataaacccaaatcttaaaacttcttttgctgactggaaatcaaagaaactttctaaaattaacccatataaatatcctaccaaacctaaaacaagaactgtaactaaggctgataaaataaacataaaaatactgaaggagcttgatgcgataccttttccaacaaataacacaacaaataagcaaacaacgtacagtatgcttattggtaagtatatgcgttattcacattgaacaaattattcctacaataaaagtatattaattattgagtattcgtatattttatttcaatcattaaagttctcgacattgtgtttacaggacgttacaattgctatctatttgtattttataatcaaatcctttttaatactgaggtttaagaatgtcaatttctattgaaacattagaaggcttacaacgccgtgtaacagttaccgtagctgcagataaaattgaagcaggttacaaagaacaattaaaaggctatgcgaaaaatgctcgtgtagatggtttccgtaaagggaaagttcctcactcaatcattgaacaacgttacggtttagcggctcgtcaagatgtattatctgaagagatgcaacgtgctttctttaatgtagtgattgcagagaaaatcaaccttgcaggtcgtccaacattcacaccaaacaactaccaaccaggtcaagatttctcattcacagcaacttttgaagtgttcccagaagttgaattaaaaggcttagaaaacatcgaggtagaaaaaccagttgttgaaatcacagaagctgatttagacaaaatggttgatgtgttacgcaaacaacaagcaacatttgcagaaaccgctgaagcagcaaaagcagatgaccgtgtgaccatcgacttcgttggttcagtagatggcgaagagtttgaaggcggtaaagcatctgacttcgtattagcaatgagtcaaggccgtatgatccctggttttgaagagggtatcataggccacaaagcaggtgaacaattcgacatcgatgtgacattcccagcagaataccacgctgagaacttaaaaggtaaagctgcaaaatttgctatcaccttgaaaaaagtagaaaacatcgttcttcctgaattaacagaagagttcgtgaaaaaatttggttcagcaaaaaccgttgaagagttacgcgctgaaatcaagaaaaatatgcagcgtgagttaaaaaatgcattaactgctcgtgtgaaaaaccaagtgatcaacggcttattagcaaacaacgacattgaagttccttcatcagcagtagcggaagaagttgatgtattacgtcagcaagcagttcaacgtttcggtggcaaaccagaaatggcagcacaattaccagcagaattgtttgaagtagatgcaaaacgtcgtgttcaagtaggtctattactttcgagcgtgatcacatctaacgaattaaaagttgatgaagatcgtgtgaaagaaactattgccgaattagcatcagcttacgaacaaccagcagaagtagttgaatactatgcaaaaaatccacgtttaaccgataacattcgtaacgtagtattagaagagcaagcggttgaagctgtgcttgcaaaagcaaaagtgacagaaaaagcatcttcatttgatgaagtaatgtcacatcaaggctaatttctctaattaataatttggcacgcattagcgtgccttatattaaatgtcgctggcgagttactttcgctatcattattcatttacattagagagaaacctatggaacaacttacttttgcagaacaatttcaacagttcgccgctaatcataccattatggttgtagcgtgggttgcactttttgttgcggtcatcatcaatttgtataaaggtgcaacaagcaaattcaaaattgtagataatgctcaagcaactcagcttatcaataaagaagatgctgtgttagttgatgttcgttctgatgatgaatttagacacggtcatatcattgagagcgagcatttaattccaagcgacatcaaaggtaaaaaaacacaggctatcgaaaaatataaagatcgtcctgtgattgttgttgatgcgaatggtttaagtgcgagtgggcttgcgaatgaacttgtgaaacaaggcttcaataaagtctatgtattaaaagagggtattgctggctggcgtacggctaacttaccgctcgtaaaaaagcataaataattcaatacattaaaattaaggaatgactatggctgaagaaaatcaagttgctactgaagagcaacaaactccgtttgaaatgcaaattcaacgtatctatatcaaagatgtttcttttgaagcgcctaatttaccaaacatttttcatcaagaatggaaacctcagttaggttttgatcttgatacagaaacgcgtgaaattagtgaagatacttacgaagtggttttacatatcaatgttcaaacaactttggaagacagcaacgatgtcgcattcatctgtgaagtaaaacaagcgggtgtatttaccatcaaaggtattgaaggtatccaattggcacactgtcttgcagcgaaatgccctgaagtgctttacccttatgcgcgagagttaatttcaagtctagtaaatcgtggtacattccctgcattaaatctttcaccagtaaactttgatgcattgtttatggactatttagctcgtcaacaagcggaagaaaacggtgagagtactacaaatactacactaaattaatcaatattatggcaatgtattagttctaaatactatactgatcacataacatttcatcttacaaagttaaaagagctggttataatgatctgaccccaaaaagttagactaatttagttcaaggactgagttctgtattccacagggcttagtccttttaatcttacttgaatacgctcatgattgtaataatgaatatattcgtgaatagcttgttccagttgctcaaaggtctcaaaccgtttaccaaagtagcattccgtttttaaacgcccaaagaaactttccattgcactgttatccaaacaatttccctttctcgacatactttgtacgatgccgttttgtttcaaaatcgactgataacttgccatttgatattgccaaccttggtcagaatagagtatcggcgttgctccgtcaagccttgccacagcttgtttcattattcggcttatctgctcgaaacttggatttcttgccacatcataagcaataatttcaccgttaaacaagtccttaatcggcgagagataaagtttaccttctgcacacttaaattcactcacatcggtgacgcatttttgatttggggctgtagtgtgaaaattctgttttagcaaattctctgcaattttgccgacttcaccacgataagaatgatattttttgcgtttgtttttccctttcaacccaagctgttgcagtaagcgttggacttttttatggttaatcagctatatttttcttaattccagcgtaatacggcgataaccgtaattaccgtcatttttgtgataaattttgataacttcttgctcaatcgctgcatttttattgtctttttcagcaagatgataaaagaacgtactccgttttaaatcaaccaattgcaataaaatctcaaacggaaattggtggcgcagttctttcacgaggcttgcaaccactggctgatgacacagcaattaggaataccaaaatgtaatgccgcttgcagagtagaaaattgaccttgtttaaccgcttgtattacagataacttaaactcagatgagtaaactcgtttgctgtggcaaacagctagtccattgataccattgtgattatactgattaatccaatatctcaatatggtttccttaacctgaaaatgctgacgagttaatgagcgatttttattatgttgaagataaaattcgatcacttgttgtttaaaagattgggtgtatttagccataaaaatctacaccttaattagttggttgtttagtccaacttttggggtgcagatcatttttatctttatgataaatagtcattttttctaaatgttatttctatttcatttcaaataaggatattttcatgcataaaatactttttattattcattcttctccatatggtgatgaacattttttcagcgcattacgtttagctttacaactacaagagcaacacaaaagtgcggttgaattaaagttattgctaatgtcagatgccgttagcgggggacttgctcatcaacagctggcagaaggttaccatttgcaacaaatgcttgaaattcttaccgcacaaggggcgatggtcaaattatgtaaaacttgcactaatgcacgtggaattacctcattaccaccagctgaaggcgttgaaattggtacattagttgaattagctgattggacggtcaatgcagataaagtgttgaatttctagttgttatcctattcttaatattagaataaaaggcataacagacagtaggatgacagggcgaaagaagtatttcgccctttttattttatatttcctatttatgagagatgtgttgccctcttcatgttttgtacgaattgtgtcaattcaagcaaacattgagggtgattgtcgaggtttcgttcaataatctgaactgtagcggaacccgagattgcaccggcagcccctaaacgcagcgcctctttaacttgttctggttttgcgataccaaaaccttgtaaaattggggcgctttgatattgggttaacccttcaataagaacatctaaattggcagcttgtgtttgattttctgcgctagtaacgccggctcttgagactaaataagtataacctcgagtatgttgagctaccgctttaattgtggattcattagcattaggtggacaaatgaaaaccggctgtacatcatgacgttgagcagcttggatatattcttctgcggcgagtaaaggaatatctgcaaccaatacggcatcaacgcccacttcggcacagcgtgcatagaatttatcaagagtttgcgcataaattaaattggcacaaagcaacagactaatcggtatgtctggataggttgaccgcactttggcaagtaactgaaaactttcttcggtgctacaacctgcattgagagcccgatcattggcagcctgaataacctgtccgtccaacaagggatcagaaaagggaaagcctaattctaaggcatccgcaccattatcaactaaagtacaaataatctcaaaagagcgctcaaaatcagggtcacaaagtgtcacaaaaggaacaaatcccccttgttttttatcagctaattgagcaaataaacggctgaaacgagatgattgcacaatcatttgatagctccttttgcagttaaaattttatccaccgtgaaaatatccttatcaccacgaccggatagattcacaacaagtagttgtgtttttgttggatcttgcttgatgagttttaatgcgtaagccaaagcatgggagctttctaaagcaggaataataccttcatgttgtgctaaagcttgaaatgcctcaagtgcttcatcatctgtaatgctctcataatctgcacgaccaatagcatggagatgcgcgtgctgcgggccgacagaagggaagtctaaaccggctgaaatactataagactcttcaatttgcccgtctttggtttgcataatcggggatctcatcccaaaataaataccgactgaaccatgacgtaaaggcgcaccatgctcaccggtttcaatgcctttgcctgctggttcaatcccaattaggcgtacacttttttcttcaataaaatcggcaaacataccaatggcatttgatccgccgccgacagccgcaataaccgcatcaggtaagcgcccttccttctccaaaatttgccttttggtttcttctccaatcattttttggaattcacgcacgatggttggaaatgggtgcgggcctgcggcggtaccgagcagataatgtgttgtggcataatttgcagcccaatcccgcatagcctcacagcaagcatctttgagtgaacaagagcctttttgtacagggatcacttcggcgcccattaacttcattcggaaaacattaggcgattgacgttcaacatcttttgcgcccatataaatacggcaaggtatattgagcattgcacaggctaatgcagtcgcaacgccatgttgtcctgcaccggtttcagcaataatacgtgttttccccatgcgttttgctaagagaatttgccctaaaacttggttggttttatgggcaccaccatgcaataaatcctcacgttttaaataaagtgtagtgttcgtgccttttgttaaattacggcaacatgttaatgctgtagggcgaccggcgtaattttttaataaatcctgaaattcttgttggaaagcaggatcttctttcgcctccacaaaggctttttccagttcttgtaaaacaggtactaagatttcgggaacgaacataccgccgaactcaccgaaatagggattaagaatggttgtcatagcatttccttttacatttttatgataattttttaggtgtttgacgctccaaaattttgttaaacaccgctgctaatttttgtgggcttttcatgcccgttagactttctacgccggaattgagatcaagacctaagcaatgttgtgataaggcaagctcaatattgtccggattaatgccaccggcaaggagcagtttagatttatattcttgagggattttcgaccaatcaaaaggctgtccagtccctccacgttgattgccgattttgctgtccaatatgtagcgatccacatggggaatcgacggaatttttaccgcacttttactttgtgttttggttgcaagggcggctaatgtaattttagggggcgcatcaactgaaattgctttccaaatttggcatgattgcggtaattgttggcgaagtgcggcaataaattcagccgtttcttcgccatgtaattgtactgcaaataaatcaagttggttgacgattttttcaataaaatcaatagattgattttgaaatacgccgacaaaacgcaagggagcctgtaccaccaactcttgagcttggcgtaatgaaagctgtcggggagaatgttctgcaaaaattaagcctccatacaatgcgccttgctcatacacggcttgtacatcctgcggacgagtaagtccacaaactttattttcgccaaaaattaaggtgcggacgctttgatggagatcgggacttcccatcaaactgctaccaataagaaaaccatgtacatcagatttcagctgttgaatttgatgatggtggtaaatgcctgattcgctaataataattcggtctgccggaatttggcgtgcaagaggcggtgtacgagcaatatcgacagataaatcatgcaaatcacgattattgatgccaataactttagcgcgaagctcaatggctcgagttaattctgtttgatttgaagtttccgttaatattcccatgcctaatccatgtgcaatttctgccaatcgacgataggtttcatcatctaacacagaaagcattaataaaatcgcatccgcttgataatagcgcgccaaataaatttgatattcgctcacaataaaatctttgcacaagattggttggttgacgagctggcgaacgcgcggaatataagtgaaatccccttgaaaatatttttcatctgtgagaacagaaattgcggaggcataacttttatagacctgtgcaatatcttctacattaaaattggctcgaatcaaaccttttgagggagaggcttttttacattcaagaatataagccggtttttgcgccgaaccttgctgaagtgcggtataaaaatcccgatcactaggttgaaggctattttgaaacgcactcaaaggaaaatgggtttgttggtgttggatccaaagtaatttatcctgtacgattgttttcaaaatactaggttgcgtgtggttttgtggcatagtgaattccttttaataacgcgttaattgagataaaacattaacacttttaccggattggatgatatccaaaacctgttgtgcattatgcttgatattctcataaccaaacaatttcatcaataatgctgtattcattgcaacggcttgggcatgttcaggtttgccttgaccttgtaacagtgcggttatcatttgggcattttctgcaggttcaccaccacgtaaagattccaatggtttggcttgaaaaccaaaatccaaaggagaaaggctgtagtaggtgattttcccatcatagatttccgctacatcagtccgtccatgaatagccacttcatccaatccacagccatgcacaacaaaagtatgttgatgaccgagttgtgcaacggtttcggcataaggtttgagtaaatgaggagaataaacaccaagtagttgacgttttggtcgtgcagggttgataagcggtcctagaatattgaagatagtccttgtttttagtgcttgacgcacagaaaccgcgtgtttaaacccgaggtggtattgctgggcaaaaagaaaacaaagcccgatttcatccaatgcctgtcttgcaatatccgcctgcatatttatattgaccccaagtgcggttaataaatcgcttgagccggttttgcttgatacacttcgatttccatgttttgcgatttttaacccacaggcagccccaactattgcagaggcggtagaaatattgatagtattggcgctatccccaccggtaccgacaatatctgcaaatgcataatcaggggtagggaagggttgtgccgcattaaggcatgccgccactgcaccactgatttcttcagcgctttccccgcgtatttttagcgcaattaacagtgcagtgagctgtattggatttaattccccttgaatgattgatgtgaaaagctgttgcatttccgaggatgttagatgagtttgctcaataattttaagtaggagttgttctgtttgcatattatattccttgtgttctattaaaattcattaaatatgcgatagtttgtttcaataattgagatccctgtacagtcaaaatactctcaggatggaattgaaaaccacaaatcggtaaagatttatggcgaattgccatgacgatattttcataagtagcattaacaattagctcatcaggcaactcaacacccattaatgaatgatagcgagcaacggacataggattattcaaactttcaaacatagctaaattatcatgagaaattagcgatactttgccatgtaacacttcgccagcatgaacaattttgccaccaaaagattcaatcagagcttgatgccccaagcaaataccaatcataggcactttgccttttaagcgcgcaattaatggcagtaaattgccggcttcagagggattacccggaccaggggataaggcaagtagggtattggggtgagctaaggtggcttgttctaacaacgctatatcacaatcgttacggtaaatctgaacctgatgacctaatgtccgaaattgatcgactaagttataggtgaaagaatcaaaattatctaaaaaaataatggttgccatgataaaaatccttatattgcactgtgagtttgaataatggcattaatcactgctttagctttatggcgggtttcatctgcctccatttgtggatcagaatctaacacttcgccacagccggcttgaatatgcgctattccgttttgcacaaaagcagaacgaatcacgatacaggtatccaaattaccttttgaggacaaataacccaccgcgccaccataactatgtcgtttttgttgttcaacaaggtaaattaattgcatagctttaatttttggcgcaccggttaaagttcccatattcatacaggcttgataagcatgcaatgcatccagttcagggcgcaattttcctacgactcgagaaaccaaatgcataatgtgcgaataacgatcgatttgcattaatgccttaacatggcgtgagccactttcacacacacgcgccacatcattacgagccaaatccaccaacattaaatgctccgcaagttctttcttatctaagcgtagctctaattctaagcgagcatccagatctggatcgatttgaccttgctcatcaaaacctcgcggtcttgaaccagcaatcggataaatttccacttggcgtgtttgtgcggaatatttcaatgcgctttctggtgaggctccaaataaagtaaacgcctcatcttgcataaagaacatataagggcttggattggtttgttttagttgtcggtatgcccgaagaggattcggacaagctaaagaaaaacgtcttgatggtacaatttggaatacatccccaatatgaatatgatgtttaagtgaacggataatatctttaaatgcctcatcttctaaattcgtgcgaacttctgtggaggcgaggatgtgaggcaagtgcggttcaactttttgcaaattttggcaaatttgcaccgcactttgattcaagtcatcggctgcctttggatgaaagcaaaaggtttgcaatgtcgctgacagggtttgatgatcaataagtaataaattttcagccaaataaaagacataatcagggcaactcaaaccatcgtcttttaattgaatattttccataggaataaaattggtgactaaatcataagcaaataatccccctaagaaaatcggaatatcgctatgctgataaagcgttgttaagcaacgtaatccatcaaaaatcgacggggcgcttagcttactgtcttcatcaagatttgggtttggcaaagaaaacttcaccgaaagatgatgggtatcaaacgaacttatttcacaaataggctgtaattgttgtgcgatgtagggtaaaaccccttgcccatttaaggtcaatgcctcgaaatcaacttgttgtccttggcaagaaatttttaatgcggcatctactagcaacaaactttttaaactgtttttactttggatttcagcagactctaaaagcaaggtattttgtcggttttggcaaagtgtcgcaaaaatggcgatgggatcattgcaataatccacatgatattctttggtttggataaaaacggactgcatttttaacatcctgtcatttgttaattttgtactattaaactagtataaattaatattgtcaactttttttagaaataattattggatgaaggaaggattcaagagaatatgaagtaggttttgggatatttagagaagggcaaaatggggttttcattaaatcaaccccattttttcggtaatatgaccgcacttgaaaggaatgactattttaatcctttcactaagtaatgaatctgccatgttaaaagttgtttataagcctgaattcgcgcccgttttttatcactcactggtttcaactcggtaactcaaagattgtcgggataaagtgcggttggattttgccaagaatattgcgtgagatgctcgccatcgctcaccccttcgctatcggcataaagcccttcgttataagcaaaagcatatttttcattgtcttgctccgccaacaaattgcgcccgcctaggtccaatattccgcatctgataagcttaaaccatataatgtaggcataatatccttgtgcgaaccaatgcggcttggatcaaatttaagggcaagtttgctctgtaattccgttggaacatgaacataaaacggtacgcccattgccataaaattctgttttggcgcatcgaaacgcacgcagcgcacgtggtgatctcctgtagcagcaataatggttcgatttcccaccgcactttgcgccacttgtgtaataaattgccccaaggcgttattagcatattgataagtggaaagggatttgcggttttcttcttcactgccaaattttccttctagtacttgaggattaatacgctccgccttgtaatgttgaggtacttcataaggcggatgattcgtcatacttaatatattgataaataaaggttcattactttctttcagtaatttttctgctaaggcaaaggcatattcatccgcaatgccccaataagacatggtaggttttgcatcaggaaaagtttcgataatatcattttggtcataacattcatccacaccttgcaacggcaaataattgcctaagttgcgccacattaaaccaccagatgtgataaacaccgtacgatagccttgttgtttataggttttaaatggactatagggcagggcgatttgctgtgcagctgattggctgatattttgaatagggctataaaaaagcaacgatgccaaagttggcgcagtgccgttataatcagaggtaaagcgtttgaacacaaaatcttgttcaaagtgcggccgtaattgtcccaataaatcattggtttcagggttatctaaaaccaaataattggtaccaaagctttccattaaggcaaatacaacatgaggtttgctttccttcaatgcaggattaacaggcgtacgctcaatcaggctatctgtgccaaagacttgttgcattaaggctttaccttcgtctaaatcaaccacctcaaaaagaatattgcgtttacgatctctaaatgcccattccacagcaattacgccatttgggactagtttattgataacggctaaagaggaaacttgcgaatgatctttggttaatggtttggagcgtattgtaccgcgtacaaaaaatgccaaggcaaggaatgagccaacaaaaagcaaagttgcaacagaccaatgcatatcccaatttaacaatccttggtataacgcataatacataaagtacgcaggaagcgcagctaacacaagcactgcgaaagatcctgaaataacagggtaatcatcatagatatttttcaacacggctttggtatcgtcttccactaaaccaaacatcaacatatcgtaataattgttataggttttatagtaataaaaattacccgccacaatgccaatgagcgcgatagcaaaaattaagatgtaaattgcccaaaaaagtgcggtgcagatcatttgtccgtctaattcataaacccaaatcggatatttagcatgatttagatgctgattaaaccacgtttggcggctttcctttgttgctggaactaaatctgccgtcactgtgcgtctttcaatctcaatcacctggttataaatttcaagaattcgagttaaatcatcttgttgtgctaggcggaacatctctatccttaaacttgctcggtacttaactgccaacctagttggcgatattgtttataacgttccctcgcttggaccttttctgtttcatcaaccgacacgaaatcaataatttgattgaagctgttaataaaattgggtaattctgtttgtaatgaaatcaatacatctcggcgttgggcattgcgtttgcctttccacgaaatttcaatcggggtcgtataggtggtgacttcgccggataaattatgtggtacaaaatcacccgcttctcttgcccaaagcgcttcatcaaggctgaatgcctgttcttcggtttcacaagcaatcagcacgcgtttaccttgtcgccacgcttttgcggctagatcgcaagcaagggcttcttgggcggaaagctcgcctacttgggcttggcttaatagatagaattgtacttgcttcactgacacactcttagaaatatagttagacgaattataacttatatttataataaaatagatgtttgaacatattcaaactacatttaatgcaatgtaaattgaaatttaagttaatgaacgttcattatacatctcctcaatctgctcccgatagcgttgcataatcactttacgacgtaatttcagcgtcggagtgatttcttccattgccgtactaaaggcttgaggcaagagagtaaacctcttcacctgctcaaagctcgggagttctttctgcaactcgtggatacgtctttcaaacatctgaataatgtcggaatgcttaatcagctcgatcctatcctgatatttgatattaagttgctttgcatattcctcaaggctatcaaaacacggcacaatcaaagcagaaacatacttctttgcatctgcaatcacggcaatctgctcaataaacttatctttaccgattttgccttcaatgtattgcggagcgatatatttcccatttgaagttttcattaactctttcaagcggtcagtaatgaataaatttccgcaactatccatttcgccaacatcaccggtgcgtaagaaaccatcatcagtaaaagcttttgccgtttcttcaagcttcttgtagtagcctcgcattaccattccgccacgcaccagaatttcattttcctcaccgattttgacttccgcatttggcattaatgtcccaatagaatttggattaaagcccttatcttgccagcaagaaactgttgcagtggtttcagtcattccgtagcccagtttaatgttgatcccaatgctatggaaaaatgaaccaatagaagcttccagctttgccccaccgcaaggcatcattttgatcctaccgcctaataaagctcgcagtttggtcagcactaatttatcggctagagcatattgcaaacgaagccacggtgatgggtgctctatttgataatgttgttcaccaatacgaattgcccagttgaacaaagctcggcgatgtagtggggctttttccactttatcccataccgccgtataaattttttcatagaagcgaggcaccgcacacatcaccgttggtttcagtgtagtcaaggcatcacggacgtggttggtgtcttccaaatagcaatttgtcgcaccacgatgaaaaacataagcaatccacgcacgttcaaaaatgtgcgaaagtggtaaaaacgaaagcgacacatcatcttcattcacatttaaagcaagatcgtgagcatttaattgatgggcaaggttagcataatccagcatcacgccttttggttcacccgttgttccagacgtataaatcagcgtaaaaagatcggataactgtttagaattaaggcgtttttcaaattccgcttcatttggaacaacattgagaaaatcttcccaataacacgcatttggaagatccctcaaatgcatattcgccttcattgccacaattttcattaattgtggacagttgttcgctatttgatagacctgatcaaattgctcttgatcaccaacaaagagaattttaatgtcagcatcattcacaatatattccacttgttttgccgtgtttgtcgcataaatcggcaccgcaacagcccttgcctgcatcgccccaaaatcagcgatagtccaacgaggcatattatttgcaaagataccgattttatcttgaatatcaatatgttgagcaattagagcataagagaagcggtcaatttcttgctgaaaagtttgccacgacatttcctgccattgagcttgttcacggaaacgcaaagcggtacgattaagccatttttttgcttgcaggcgaaatctattcacaaaatggaagtcgagagaagccatctttttatcctgtttattcagcttacaaatgttcgctaatatacttttttcactaagaaaaagctagagaaatgtgaacaaatgtaagctgaaatatagcttatctgtattcttaagcaatggtaatctgtgctttttgtatcattgactgccttactgcatctgctacttttaccgcatcaattggctgttctgtcagaacggattgtgcattatggcttaagtgatttagtactgttaatgcttcaatttcggttgctcggcttagccataaaggtacgagtgcatttaagtcattataacgttggatagctttaccgttttcgcgtaaggataaatcggcttcaaattcatcgtacaaattaaattgctgacgttgtccatttgcaagggtgagggtcattgtggagttgaagaaattgataactagtgcccccaattctccgtgaatggatataccccattcgtgtagtcgataagcagttcccatttctaaataggcaaatacgccactattaaattggagaagtaattggataatatcgtggttatcaatgttatccaaatgcgctctattggttgattgagcatagactgattttacatcgccaagtaaccaacaaagaaggtcaagttcgtggatttcgttaaatagttttccacctgtcagggatacgtcatttttccaccagtttttatttgctgggctatcaatccaacgttgtcgggttgctctggctactgtaattttgcctaatacattttcttgcataaactgtttggctttcattacgccaggtaaggttcgaagtagatgtcctgccagggcaaccgcatatgttgtccatttttcaacctacacgccgagcaacagctcatctcgaaattcatctgaccaaccagcagcggtcaatttccctttcatactctgctttttcgggtgtaatcgagccaagttcaacgctaatcgacgcaaaattgccagattttccgcaccccattcatcggtcacagcacattcgtcttctttatagaccacatctagcacccaatgggctttgttttctacttcccaatgccctcgcacgcacttcgccaacatttgaatatcaacatccaaactactgatataaaagactttttcttgcgattctttgccattatctgaccgcttgcgacacacctccaacaccgattttatccccttccattcctccgctttgctcagccaatcactcactttcagcttacggtagtaacgctcatcaattcgacgacgttccgcatttacctcctcaaacgtctcaagcatttcggggcaatctcggctgattttgtgaaaatacgcctccacttccgactgaaattgacggtgatttttcttcaacggcatcacataatcccctttcttttcgatgattttctccgcaattttcttctgtgtattcatcgcatccaccgttataacggcattttttaagcaaaaactgtcgataatttccatcaccgcctgctgctcattttgcttacccgaggattttttctgcgataaaatcaaaccacgagactggctccacactgtcacactgtgcaaagcactttgggtttccggattgaaactatgacgaagtgtcttgccatcaatcgcaatcacttcacgtccttgttgtgtgcgtatctcattgataaaattaagaaaaacctcattaaacgcttgtggctcaatgcgttttattacacgagcgatagtatcatcgacaggaatgccacactcaaaaggacgatattttcgcaaccaatccaaatgtaattcgccaaaaagtttgatttcagtccagctgtttgcccccgaaatcacggcactgatgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgcgatcttgccctgttaaagcacttttttatttacaattttgcttgcaattacagagtgaaataggtagaatatggggcactttaaccaactaggttaaggtcgcttagtgtaatcatttactaagtggtgttacagatattgtgacacttaacaatgtttccgatttgggaactataacaaggtatgactgtgcccccttaacttaagtttgttaagcggtggttcggttttttattagctaaattttaatggagctctggtctaatgcagaaccaaagaatccgtatccgcttaaaagcatttgatcatcgtttaattgatcaatctactgcggagatcgtagaaacagctaaacgtactggtgcacaagttcgtggtccgattcctttaccaactcgtaaagaacgtttcaccgtgttgatttctccacacgtaaacaaagacgctcgtgaccaatacgaaattcgtacacacaaacgtttagtagatatcgtagagccaacagaaaaaactgttgatgcattaatgcgtttagatttggctgccggcgttgacgtgcagatcagcctaggttaattaagaggttattacaatgattggtttagtcggtcgtaaagttggtatgacccgtatcttcaatgaagacggcgtgtcagttccagttaccgttatcgaaatcgaagccaaccgtgtgactcaagttaaaactcttgaaaacgatggctatactgcagttcaagttactactggctctaaaaaagcaagtcgtgtaactaagcctgaagcaggtcatttcgttaaagcaggtgttgaagctggtcgcggtttatgggaatttcgtactgaaggtgaagaattcactttaggtcaagaaatcaacgtagacatcttcacagatgttaaaaaagtagatgttactggtacatcaaaaggtaaaggtttccaaggtggtgttaaacgttggaacttccgtactcaagatgctactcacggtaactctttatcacaccgtgtacttggttctattggtcaaaaccaaactccaggtcgtgtgtttaaaggtaaaaaaatggctggacacttaggtgctgagcgtgtaaccgttcaatcacttgaagttgttcgtgtagatgctgagcgtaaattattattagttaaaggttctgtacctggtgcaactaatagtgatgttattgttaaaccagcagttaaagcataagtctaggagatagagatggaattacaagttgtaggtgcgacagcactcagcgtttctgaaactaccttcggacgtgagtttaatgaagcgttaatccaccaagtagttgttgcttatgcagcaggtgctcgtcaaggtacacgcgcacaaaaaactcgtgctgaagtgtctggttcaggcaaaaaaccttggcgtcaaaaaggtacaggtcgtgctcgttcaggtgatatcaaatcaccaatctggcgttcaggtggtgtaactttcgcagcgaaaccacaagatcacagccaaaaagtgaacaagaaaatgtaccgtggtgcaattaaaagcattctttctgaattagttcgtcaagaccgtttagtggttgttgataaattcgaaatcgatgcaccaaaaaccaaagttttagtacaaaaattaaaagatatggcgttaactgacgctcttatcatcactgcaagcttagatgaaaacctattcttagcggcacgcaacttatacaaagttgatgtacgcgatgtacaaggtatcgatccagtaagcttaatcgctttcgataaagtggttatcactgttgatgcagtaaaacaaattgaggagatgttagcatgattcaacaagaacgtttgctaaaagtgcttaaagcaccacatatctctgagaaagcgacaaataacgcagaaaaaggcaacacaatcgtatttaaagtagcattagacgctaacaaagtggaaattgcgaacgcggttgagcaacttttcgaagttaaagtagattctgttcgtacagtggttgttaaaggtaaaactaaacgtcacggtgcaaaatcaggtcgtcgtagtgactggaaaaaagcttatgtaactcttcaagaaggtcaatcacttgacttcgttgaaggtgcggcagagtaatttcggaggaatagaaaactatggctatcgttaaatgtaagccgacctccgctggtcgtcgtcatgtagttaaagttgttaatactgagcttcacaaaggtaaaccttttgcagcgcttttagatactaaatctaaaacgggtggtcgtaacaacttaggtcgtatcactactcgtcacatcggtggcggacacaaacaacactaccgtttaattgacttcaaacgtaacaaattagacattccagctgttgttgagcgtttagaatacgatccaaaccgttctgcgaatatcgcattagtactttataaagatggtgaacgccgttacatcttagcaccaaaaggcttagctgcaggtgatacgatccaagcgggtgcttcagcaccaattaaagtaggtaactcattaccaatgcgtaatatcccagtaggttctactgttcataacgtagaattaaaaccaggtaaaggcggtcaaatcgctcgttctgctggtgcatatgtgcaaattatcgcgcgtgaaggtaactatgtaactttacgtcttcgttcaggcgaaatgcgtaaagtattagctgagtgttctgcaaccatcggtgaagtaggtaactcagagcatatgcttcgcgtacttggtaaagcaggtgcaaaccgttggagaggtattcgtccaaccgttcgtggtactgcgatgaacccagtagaccacccacacggtggtggtgaaggtcgtaacttcggtaaacatcctgttacaccttggggcgttcaaaccaaaggtaagaaaactcgtcacaacaaacgtactgataaattcatcgtacgtcgtcgtggcaaataattttttaattaattaaagaggataagccatgccacgttctctcaagaagggtcctttccttgacctacacttgttgaagaaggtagagaaggcggtggaaagcggggataaaaaaccaatcaaaacttggtcccgtcgttcaatgatcattccatcaatgatcggattgaccatcgcagtccataatggtcgtcagcatgttccagtttatgtttctgatgaaatgatcggtcataaattaggtgaatttgcaccgactcgtacataccgcggtcacgccgcagataagaaagctaagaaataagaggtaaaagatggaaactattgcaaaacatcgttacgctcgtacttctgcacaaaaagctcgcttagttgctgatttaatccgtggtaagaaagtttctgcagcattagaaatcttaactttcactaacaaaaaagcagcagctttagtgaagaaagttttagagtcagctatcgcaaacgcagagcacaatgacggtgcagatgtcgatgatcttaaagttgcgaagattttcgttgatgaaggtccaagcatgaaacgtgttatgccacgtgctaaaggtcgtgcagatcgtattttaaaacgtactagccacatcactgtggtagtgtcggatcgttaatcagtaggagaatagcaatgggtcagaaagtacatccacatggtattcgccttggtattgttaagccttggagctctacttggttcgcgaatacacaagatttcgctgataatttagaaggcgatttcaaagtacgtcaatttttaaacaaagagttagcgaacgcgtctgtatctcgtattactatcgagcgtccagcaaaaagcattcgtgtaactattcacacagctcgcccaggtatcgttatcggtaaaaaaggcgaagatgttgaaaaattaagaaacgcagtatctaaaattgctggcgttcctgcacaaatcaacatttctgaagtgaaaaaaccagagctagatgcaaaattagttgcagatagcattgctgctcaacttgagcgtcgtgtaatgttccgtcgtgcaatgaaacgtgcggtacaaaacgcaatgcgtttaggtgctaaaggtatcaaagttgaagtaagcggtcgtttaggtggtgcagaaatcgcacgttcagaatggtatcgtgaaggtcgtgtgcctctacatactcttcgtgctgacatcgactataacacagctgaagctcacacaacttacggcgtaatcggcgttaaagtgtggatcttcaaaggtgaaattcttggtggaatggctgcagtgattgaatctgagaaagaaccagcggcacagcctaaaaagccagctcgcaaaggtcgtaaataaggagatcactgaatgttacaaccaaaacgtacaaaattccgtaaagtacacaaaggccgtaaccgtggtgtcgcgggcggtacagaagtgagcttcggttcattcggcttaaaagcaattggtcgtggtcgtttaacagctcgtcaaatcgaagcagcgcgtcgtgcgatgagccgtgcagtaaaacgtcaaggtaaaatctggatccgtgtgttcccagacaaaccaattactgaaaaaccattagaagtccgtatgggtaaaggtaaaggtaacgtagagtactgggtagccttaatccagccgggtaaagttctctatgaaatggatggtgtatctgaagaagttgcacgcaatgcattcgcattagcagcagctaaacttccgttcaaaaccacatttgtaactaagacggtgatgtaatgaaagctcaagaactacgtaacaaaagtgttgaagagctgaatggtgaattagtgaaccttttaggtgaacagttcaaattgcgtatgcaagcagccaccggtcagcttcaacaaacccaccagttaaaacaagtgcgtcgtagcattgcacaagttaaaactgtattaaccgaaaaggcgggtgagtaatgactgataaaattcgtacagtacaaggtaaagttgttagcgacaaaatggacaaatcatttgtagttgctatcgaacgcacagttaaacacccaatttatggtaagtttatccgtcgtacaactaaattacacgtacacgatgaaaacaacgaagctaaattaggcgatgtagttgaagtgaaagagtgtcgtccactctctaaaactaaatctcacactttagttcgtgttgttgaaaaagcagtagcttaatcaacaataaaaattaagacccctagcagaaatgctgggggtttttgtttttttcacgattgctaaatgtatcttttctttacatttatgtcttttccttaataaagtaaacttgtagcaaagctccacatttttatattaatatagagaattgtttcaaaaatgttaactatatcacagatttttagtgtatttagtagtttaatacgtttgtgaaaatatagagggggtatatctaattttcatatattgctatgttgtttttttgctgtatcagtaaattttaattatttaaagcaaaggagaaaaaaatgaaaagaagattatctaaaaatgttaaatgcagttttgtaccttcattgatttttctagcattagcatctaatttgcatgctactacgttctggaaaagcgatttaaacgagaatctaactcatataactaaacgaataggtgaggataattttacggtagctgaagacggacgattatggcctggtgtaggtcctaatggagaggctcctggaacagtacctctatattatagtcgtattccagcaatgaccattacagatgataataaaatggtcattatgtatgatttaagatggaacagagcatatgatcaagacagaatcgatccaggggtatccatttcagaagatggaggaaatacttggttaagtaaaacagcttggacatttaatgattctaaaatgcctttgcgaagagctatggatcctacgattttgtataacagtatagatggtagtatctatgctatgcatgggacttgggctacaggtaatagaaattggtatcaagatcgtttcaactattttcaaaataatatttgggctacaaccatttataagtctatagatggagggaaaacttaggagaaaaatgctgaatttagtaaattaagtaaccccgatgttttttctaaagtaagtaaaggtccagataacccagtagttagttttttaggaggtgttggttctggtattgtgatgcgtaatggaacattagtatttccaatacaaactgctcataataatggtattgcagcaaccattatgtattctaaagataatggaaaaacttgggaaatgccagaaacaacggatcttccagcaccgaatcaaatctctttagagaatatggtttttgagatgggggataaattaattatggttggaagggaggcgagagtaagaggaactcaagcagataaacgatgggcatactatacagaagatatgggtaagagttggcatgcttatgaacctacgagttttggttctagtacagcccaaccaactcaaggctcatcaatttatgttaccttgccaaacggtaggagagtattgctcgtttcaaaacctaatggtaataatgataactgggctaggggtaaccttgctctttggatgctagatgcaaaagatccacaacatgtatatgaggtggctattatcagacctggttctggaaataaagcgggtgctggttattcatctttggcttataaagagggaaatttatttgttgcttatgaggatgatggaaatattactgtaaaaaatttgacagaatatatgacagatattcaagctaaagcccttgaatggaatcttcctgatgaaattgaacctgatgttgaaaaaattaatgctttaatgcatttgaatcaggggcaaaaagacgaattgattgctaaacttcgtagggcaaatgataatgcaatagcacagtctattacgcttgatcaggctatgtcagaattaaaactcaaaagctttgcattaagtcaacaagcggtttcttttgaaaaggctttaccatccaatcttaagaatttccaagatgcattagcatctattaatactatttcagaatctaagaatacaacaaatgtcaattatttaggtgttcatgatttatatgatagcttgtataccatgtttttagctttgaataatccattggactttaccaaatatattgagcaggctaagcatttaaatgaatacaaccatgatattttgtatcgctcctttgatgatgtttttgctcattatagtggaggttcaaaatataataagctctctttaggtggaaataagacggttagtgaaaaagttcaggctggattgttttttgaatatggcaataaacatcaaaaaagttatcacgttggtatgagagcaaaatatcaactggataatcatcagattgctggttttattcgttaccgtggcgtaaaacaccaagactttattgaacgtaataacaatgttgatctttatttgaactatgcttatcaacttagattgagtgaagatctgagtgtgagtccttcgtttggtgcctatatttctcgttccaatagaacattgttagatcaggatgtcgctgttaataagagaacagtttatgctggagatgttggtgtgaatcttatgtataagataaatgatattaatgtaaatatccggccaaatattgcattcatcaatgacagtctgaaactatctcaatctaatgataagagtaatgtgtataaaattagttcacataatacaatttatggattggcaactagtattaataaagctttttcaaatggattgaaagtaggttcaacattagaattgcaaaaatatggtagtcaatattctaatgtaaatttaggtgtagatatcagttatacttggtaactagaccctatcccaaattctgtgtaaacacccatttcaacttaacggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacgaatcacgctattaagcgattccacggcattcgtggtataaatcgctttacgaatatcagtcggataatcaaaaaatgtagcaatatttgcccagttatcttcccagcctttcgctacaagcgggtattttgcctgccatttttgcgaaagtgcggtcagattttcgcgagcctgtgcttccgtcggggcttgataaacctgctttaaatatgcagtgacggctttgtaatctttccacgaaacgaatttcaagctgttacgcactaaatgcacaatgcaaagctgaatcttcgttttaggatagactgcattgatggcttccgggaagccttttaaaccgtctacacaggcaataaaaatgtctttcaagcctcgattttgaagctctgtcagcacattcgcccagaacttcgtactctcattttcagcaatccaaagccccaataactcttcccttggcatataaggcaataatctgctcatccattcctatgatgcgggtttggtttttcttgataagttgaggttcaaaggtgccgtcacggtcacgaggcgtctcaatttctatctcaccttcatcacaaatgacggtcttagatgtgtaaccgttacgtgcatttttaccttttctaggctgatgtttttcataaccaagatggtcggtcagttcaccatttaacgcagcctcgacggtgatttgcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttatacaaattgtgggagaggctcgagaggctcttccggcatagtagacaaaatggttgctaatgaatatttttaattattcttagcaactctttttatttaaaaaatcctttataaacataatcttatgtcttttcattaatcctgtatgatgcgataatttttcctttagtggtccaaataagttttcaagtctatttgtcgttttttcgatatttaaatcgccatgcttttcataggtaaatagataatccatataacgtttaaaactatgataagcacttcttacattccgatgtttataaggataatagcccttttcattcggtttatctgaccgttcttctaaaaacgctttatgttttaaataccaatgatgtaatcgtaaatagacgtcttttttagaactctgtttaagcgttaatgctattgtttttaattcttttccagctatagattgatgtttttttcttaatgctctcatcacaatagctaccatatgaaaatggcacatttgcgtcggtgtatctaatatttaaatcacgtgatagtggtggatttaatttctttttaagggtaaatgttttattacaagcattacatttatagcgttgaatattatttcttataccatgtttgcgaatgtcgctactgtggcaaaaatgacattttttgggttcataattcaaaaaagtggcttaaagcccgtaatataaggttttaagccatttttttagtggccattttgtatactatgctattttaggagtaatagacttttcttataaaaacggcttcattggggtatagtagacaaatttgttgctaaaacatttgcacaatacgatccagttcaaccttagccgcttcaacagctttagccgcaacttcaggaccataaccgataccttctgcatacacaaactcaacatcagtaataccaataaagtttaataccgtttgcatatacattttggctaagtccgcaggaccatctttataaataccaccgtgagcaagcactaccactgcttttttgcctttgattaagccttcaggaccattcgctgtatagcggaaagtcacacctgcacggtttaagtaatcaatataggttttaagttgagcaggaatacctaagttgtacattggcacagcgaatacaagtacatcactgttattcacctcaccaatcaatttgttagataaatccaatgctgcacgttgagcatcattttgtggttcaccgcgcgtgcctgatgccgcatttaaatcataataaggaagtggatttaccccgaaatcgtgttcagttacgttcgctgaaattttagatttaaggtaatcaactaatttatttgaagtggaattatcggcaaggatacttgatttgatcactaatacatttttcattaaaaactccgaagatcgaaaatacgattgaataactacgcattagtttatctaaatatgaagagaaataaagtaggggaaagtgaaaagagtgtttattaaaatgaaataatatatcaatttgcaaaatgttaaattattctgaccgctcataaaacacaagctcaagtatttactcgagcttatgtataaaaaagtgtttactattcttttgtcatatcagacataaacatataagcacctataaagattctagctaaagtattcaataagtaagcctcactaataccctcctctacatccagatcatcttgtaaaacaagaccataatcttcaacaatataagcagtgaaaaatctttttgtcgcattccatttattgacgcttttcaatgaagtattatcaccgtcaaaatacatcttaaaagataaagagccattgtcacgctcattaaaaattatcagttttagcccagagtcactggtaattctgatccttcctttttcaatcaacttaactgttggatattttttcttcacaatatcaatcaattgttgatcagaaaacttggtataaatttccaccattttggtttctgcataagctgttgtagaaacaactgtaatagtaatcaacattgtgaaaaacattgataaaaaataagtgggcattttgagatatttacaaattttcataaacacctccaccattttctaactgacgatagagattgagagaaagtttatcccttgtttgagcggcaatatctgtttcgtaaagctgcttatcaacaggattgcttaaatcatactggtagtaagttccacttaaccctttataagcaaacataccgtttttcatctgttctttaatcataaatataccttcatagtaatgctaaatgttttggcagagatgattttagttcattacgcaagtaatgaactaaataatgctagcattatttaaaattttgataaaagatggtaacaaacggtgagatatgagaagaattttgaaaaacaaaagcccgataaatctatcgggctttttaagtcaatgtagaattactctgctgcttgttcagctgcaacttcaggacgatcaactaactcaatgtaagccattggcgcgttgtcacctgcacggaaaccacattttaagatacgagtataaccacccgcacggtttgcaaaacgtggacctaattcattgaataatttagcaacggtttcgatgttgcgagtacgagcaaaagctaaacgacgattagcaacgctatctacttttgctaaagtaattaatggttcaactacacgacgtaattcttttgcttttggcaatgttgtcttgatgatttcgtgactaactaatgcacttgctaaattacggaacaacgcctgacgatggctgctgttacggtttagttgacgtccactcttacgatggcgcataaccttattccttctaagaaaatctaaacctaaaattagtcttcagcaatacttgctggaggccaattctcaaggcgcataccgagtgataagccacgagaagcgagaacatctttaatttcagtaagtgatttcttaccaagattaggtgtttttaataactcaacttctgtacgttgtactaaatcaccgatatagtgaattgtctctgctttcaaacagttagcagaacgaactgtcagctctaagtcatctactggacgaagaagaattgggtcaaattccggtttctcttctttcacttctggctgacgaacatcacgcaaatcaacgaatgcagcgagttgctctgctaaaatcgttgcagcacggcggatggcttcttctggatctaatgttccgttagtttccatctcgataacgagcttatctaagtctgtgcgttgttcaacacgagcagcttcaacattgtaagcaatgcgatctactgggctaaaacgagcatcgactaataagcgaccgattggacgatcgtcgtcttgtgtatgtacacgagcagatgctgggacataaccacgaccacgttgtacacggatacgcatactaattgatgcgtttttatccgttaagttacaaataacgtgatctggattcacaatttcaacatcaccatcgtgagtaatgtctgctgcagttacagggccaatcccagatttagtgagtgtcaaaataatatcatctttattttgcacttttaccgctagacctttaaggtttaacaatacctcaagaatatcttcttgtacgccttctttgctgctgtattcgtgtaatacaccatcaatttctacttctgtaactgcacaaccaggcatagatgaaagtaaaatgcgacgaagtgcgttacctaaagtgtggccgaaaccacgttctaacggctctaaggtcacttttgcgtgagttgaactaatttgttcaatattcactaagtgtggctttaaaaattctgttacagaaccctgcattttatcctctctttgcttttaagcttaactattatttagagtaaagctcaacgatcagatgttcattaatatctgctgatagatcagaacgctcaggagtacgtttaaatacgccttccattttagttgcatcaacttctaaccaagttggtttttcacgttgagtagctaactctaatgatgctttgatacgtgcttgttttttagatttctcacgaacagcaatcacatcatcaacagaaacttggtatgaaggaatgtttacaacacgaccatttaccacgatagatttgtggcttactaactgacgtgcttcagcacgagtagctgcaaaacccatacggtaaacaacgttgtctaaacgaccttctaacaatactaataagttctcaccggtattgccttttaagcggttagcttctttatagtagttacggaactgacgttctaaaataccatagatacggcgaactttttgtttctcgcgtaactgactaccatagtcagataaacgaggcttgcgagcaccgtgttgacctggtgctgtatcaattttacattttgactcgatcgcgcgaacacctgatttaaggaataaatcggtaccttcacgacggcttagcttgagttttggacccaaatatcttgccattttctttctccaattatcctaacgtcaattacacacgacgttttttcggtggacgacaaccgttatgtggaatcggagtcacatctgtaatgttcgtgatacggaaacccgctgcgtttaatgcacggattgttgattcacgacctggacccggacctttaaccataacttctaaattctttaaaccaaactctttaaccatttctgcacaacgctctgcagcaacttgagcagcaaatggagttgatttacgagaaccacggaaacctgaaccacccgcagttgcccaagctagagcattaccttgacggtcagtaatggttacgattgtattattgaaagatgcgtggatatgagctacgccatctacgatctgtttttttacacgtttacgtgcacgaactggtgttttagccattatttatctactccgattattttttgatcggtttgcgtggacccttacgagtacgcgcattagtcttagtacgttgaccacgtactggtaaactacgacgatgacgtaaaccacggtagcaacctaggtctaaaagacgtttgatgcttaaagttacttcacgacgtaaatcaccttcgacagtaaatttaccaacttcttcacgcagtttttcaatctgctcttcagacaattctctgatcttcacatcttcagcaatacccgttgcagcgcagatcgcttttgcacgagttttaccgatgccataaatagcagtcagtgcgattacggtgtgtttttgatcaggaatgttaatgcctgcaatacgggccactatgcactcctatttaactaaaattattgatatgctgatcttgaaaagcccgtttcaggatactcaaacagcatatcaggacgaaatgagctgagcagtataactgctcagcaggttctttgcaagaaataatgtcaattaaccttgacgttgtttatgtttagggtcgctacaaattacgcgtacaacaccttcacgtttaacaactttgcagttacgacacattcttttaactgaagcacgaactttcattgcttatccttttgatctaagggcttattgccctaagcctttcaaattggctttcttcaacacagagtcatactgtaaagacattagatgactttgaacctgtgcgatgaaatccataataacaaccacaacgatcaataatgaagtaccgcctaattggaaagatactttccataatgatgttatgatataaggaaccaaacaaacaaaggtaatatataacgcaccaattaaggttaaacgtgtcattactttatcgatataacgagatgtttgctcgcctggtcgataacctggtacaaacgcacctgattttttcaaattatccgctgtatcacgaggattatattgcattcctgtataaaagaatgcaaagaagattacagccattgtaaataatacaatatagagtggctgacctggttgtaacaactgtgataaatcaaataaccattcaaaaccttcacttgttccgaaccattgtgcaatggttgctgggaataaaataatacttgaagcgaagattgctgggattacaccagccatatttacttttaatggtaaatgagattgtcttgcaggtgccatcattcttccctgctggcgacttgcatagtttacaacaattcttctttgtccacgttccacgaagacaacaaaatatgttacagcaaatgcaactacagctattagtaataacactaataatgaaatctcaccttggcgagattgttcaatagtttgcccgattactgatggaagatcagcaacaatccctgcaaaaataattaacgaaataccattgccaatgccacgttcagtgatttgctcacctaaccacatcaggaacatagtacctgttactaaactaattacagaagttacatagaacagcatatttggattaggaactaatccagctagcatattcggtagggctaatgaaataccaatagactgaataaatgctaataacaacgtagcataacgtgtatatttgctaattttacgacgccctgcttcaccttcttttttcaactcggcaagtgctgggtgtactgctgtcaataattgaataataattgacgctgaaatatagggcatgatccctaacgcaaatatagaagctctacttaaagcaccaccagagaacatattgaacatatcaatgatggtgccttgctgttgtcgtactagctcggataatacagaagcatcaataccaggaacaggaataaaagaaccgatacggaaaacgattaaagcacctaaaacaaacaataatcgtgattttaattcaccagtccctttttgggtattaccttgatatcctggttgtttagccatttattattcctcgatagaaccaccagcagcttcgatagcagcttttgcacctttagttacgcctaagcctttaaccactactgctttttccactttacctgaaaggattacttttgcagataaaatatcttttgtgattacgtttgctgcttttaacgcatctaaagtaacaacattaccatctacttttgctaagtcacttaaacggatttcagctacgtgtaatgctttaagagaagtaaaaccaaattttggtaaacgacggtataaaggcatttgaccaccctcgaaaccacgacgaacaccgccgcctgtacgagatttttgacctttatgaccacgaccaccagttttacctaaaccagaaccaataccgcgacctaaacgttttgcactgtgtttagcaccttcagctggagaaagagaatttaaacgcattctattattcctccactttaaccatatatgaaacttgattgatcataccgcgtactgctggagtatcttctaactctacggtatgacgaatatgacgaagacctaagcctttcaacgttgctttatgcttcggtaaacgagcgatagagctacgagtttgagttactttaatagttttagccatattcaattaccccaagatttcttcaacggttttgccacgttttgcagcaaccatttctggtgatttcatatttgctagtgcatcaattgttgcacgaacaacgttaattgggttagttgaaccgtacgctttagaaagtacgttgtgaacacctgcaacttctaatactgcacgcattgcaccacctgcgatgatacctgtaccttcgctagctggttgcataaacacgcgtgaaccagtgtgagaacctttaacagggtgttgtaatgtaccttcgtttaacgctacattaaccatattgcgacgagctttttccatcgctttttggattgctgccggaacttcacgagctttaccgtaaccaaaacctacacgaccgttaccatcgcccaccactgttaaagcagtgaaactcataatacgaccaccttttacggttttagatacacggttaaccgcgattagcttttcctgcagttcaccagcttgtttttcgatgtttgacatctcaaattcctctattagaactgaagaccagcttcacgagcagcatctgctaatgattgcacacgaccgtggtatttgaaaccagaacggtcaaatgcaactgctttaatacctttttctaaagcacgttcagcaacgattttaccaacgactgctgccgcttctttattaccagtatatttaacttgctctttaattactttctcaacagttgaagctgctgctaaaacttctgagccattcggtgcaatcacctgcgcatagatatggcgaggtgtgcgatgcacaactaaacgtgttgcaccttgctctctcattaaatgacgtgcacggcttgcacgacggatacgagctactttcttatccatagtgttaccttactttactttttcttcgcttctttaatacgcacaacttcatcagcgtaacgtacacctttacctttataaggctctggtttgcggtatgcacgaatatcagctgccacttgaccgattaactgtttgtccgcagacttaagaataatctcagtttgtgatggacattcaccagttacacctgctggcaactcatgttcaaccgggtgtgagaaacctaaatttaatgcaacagtgttgcctttcatttgagctctgtaaccaacacccactaattgcaatttcttagtaaagccttcagtaacaccgataaccattgcattaacgagggcacgagctgtacctgcttgcgcatctgcattaacgatacccgcttttggagcgaatgttaaagtatcagcttcgtattttacttcaactgcattgtgaatttcgcgagataactcgccatttttaccttttactgttaatagctgaccattcaaagtaacttgaacgccggcaggaacagcgacaggtgcttttgcaacacgagacatttttcctacctcactattatgctacgtaacagataatttcaccgccgagacccgcttgacgcgcagcacggtcggtcattacacctttagatgtagaaaccactgcgatacctaaaccacccattacttttggtaactcgtctttacgtttataaatacgaagacctggacggcttacgcgttggatactttctacaactggtttgttttggaaatattttaaagtgatttccaattcaggttttgaaccttcaacaactttgaagctctcaacataaccttcttcagctaaaacgcttgcaatagcaacttttaacttagatgaaggcatactgattgcaactttattcgcagcttgaccgttacgaatacgggtcagcatatctgcgattggatcttgcatgctcatgtatttactcccatgattccaaattaaaagaggttattaccagcttgctttcttaaggcctggaatttcaccgcgcattgcagcttcacgcaccttaatacggcttaaaccaaacttacgaagtacaccgtgtggacgaccagtttggcggcaacggttacgctgacggattggactagaatcgcgtggaagtgtttgtaattttaacactgctgcccaacgatcttcgtctgaagaatttacatcagaaataattttctttaattcttcacgtttagcgtagaatttatcagctaatttcgcacgttttacgtcacgtgcaatcattgattgttttgccacgataacctaccttatttacggaatgggaaattgaaagccgctaataaagcttgaccttcttcatcagttttcgctgtagtggtaatagtaatatctagaccacggacacgatctactttatcgtagtcgatttcagggaaaatgatttgttcacgaacacccatactgtaattaccacgaccgtcgaatgatttcgcgtttaaaccgcggaagtcacggatacgtggaacagcgatagtaatcaatctttcaaagaattcccacatacgttcaccacgtagggttactttgcatccgattggatatccctgacggattttaaagcctgcaacagatttgcgtgctttagtaattaaaggtttttgaccgctgattgctgttaaatctgctactgcgttgtctaacagttttttgtcggtcaatgcttcacccacacccatattcagggttatcttttcgattcgtgggacttgcatgacagatgagtagttgaattttgcttttaattcattaactactgtatctctgtagtaatcatgcagtttcgccatcgcattactccagttaattaaattgttttctcgttagatttgaagaaacggacttttttgccatcttcgaatctaaatcctacacggtcagctttgtttgtttctgggttgaaaatcgcaacgtttgacgcatcaatcgcagcttctttcttcactaaaccgccagctttgcctaaagcaggaactggtttttcgtgtttagtgataatgttgataccctcaacaaccactttaccgtttggtaacactttagttaccttaccacgtttgcccttgtctttaccagcaagaacaattacttcatcgttttgacggatttttgcagccattacattctccccttatagtacttctggagctaaagaaatgatcttcataaacttctcagaacgaagttcacgcgtcacaggtccaaaaatacgagtaccgattggttgctcagtgttattgtttaaaattacacaagcattgccatcgaaacgaataactgcgccatctgggcgacgaacacccttcttggtgcgcacaacaactgcttttaacacatcaccttttttaactttaccgcgtggaattgcttctttcacagtaactttgatgatatcgccgatagcagcgtaacgacggtgcgatccacctagaaccttgatacacattacgctacgagcccctgagttatcagcaacatccagcatagtctgttcttggatcatattagtgctccgttaaaataaaaaacaccctttcgggacgaacctatttaccctatgcaaataggttgcggattatatcgcaattagcgtaataagatcaactgaattttattagaatgccaggacaacatatgcggttgccctgattatcaacgttgattgaatcacttggaatatatgatttatattcaacaattttcaaattaatgcatacaagccagctcttttctttagtgtattatgctaccaagtcttatcctcttaacgagcaatccccttatgtcttaacaacgcatctaacgtaggtttgcgaccacggaagcgttcaaacaagaccatcggctcttctgaaccgccacgggttaagatgttatctaggaaagactgacctacctcacgattgaaaataccttcctcttcaaagcgtgcaaaggcatctgctgataacacttctgcccataagtaactgtaatagcctgcggcatagcctcctgcgaagatgtgggaaaagctgtgtggggtacgcacgaaagtcggtaattctaccactgcaacctgtgctttgaccgcttttagcgtatctaacacaatattttctttcggctcgctcatatgtaagcggaaatcgaataagccaaattctaactggcgtaacacaaacattgctgcttggaagtttttcgctttcagcaactgggtcaatttctcttttggtagtggctcgcctgtttggtaatgtcctgaaataaaggcaagggcatcttcttcccagcaccagttttcaaggaattgacttggtagctcaactgcgtcccacggcacgccgttaatccctgaaacgtcacccacatcaatttcggtcagcatatggtgaataccatgcccaaactcgtggaacagcgtagtaacttcatcgtgtgtaaacagagcaggtttatcgccaatcggtttattgaagttacaggttaagtaggcaacaggtttttgtaatgaaccgtccgctagacgtttttgattgatacaatcgtccatccaagcaccgccacgtttattttcacgggcatatagatccaaatagaatgagccacgcaagcggtcagtttcatcgaaaatattgaaaaaacggacattctcgtgatagctatcaaattctttctgctcctccacccgcataccaaaaatgcgtttcaccagttcaaataaccccgaaagcacacgttcttcagggaaataaaggcgcaactcttcatcgttgatcgcatataaggcttgtttctgtttttcactataaaacgcaatatcccacggctgtaattcgcttacgccatagctctcttttgcaaaggcttttagctcagctaactcttttttgccttgctctttagaacgatttgctaaaccttccaagaaatcaaccacttgcgttgggttttccgccattttggttgcaagggaaagctcggcatagctttcaaaacctagtaatttagctaactctaagcgtaactcaagggtttccgccataattgcagagttatcccatttacctgcatttggaccttgatctgacgctcgtgtgttataagcttcatacattttctggcgaagctcacggttttcacaataggtcatcacaggcaaatagcttggaaactcaagggtaaagcggtagcctgatttctctttactttgtgctgaaagtttcgccccttcaagtgccgactctggcaagcctttcagatctgcgtcatcatcaatcacaatatcccaacccattgtcgcatcaaggacattgttgctaaattgtgagctaagttcagataaacgagcagaaatttcgccatagcgtttttgtttatctgctggcaatgagatccctgataactcaaaatcacgcaagctgttttcaatcgcttttttctgagcgagtgaataagtggcaaactcagggctatttttcagtttgacatagccttgatataaaccttgatgttgcccaacccaagtgctgtattcggataacatcggcaaacacgcttgataagcttcacgcagttcagagctattttttactgaattgagatgcccaacaggcgaccacgcacgagagagtttatcccctgtgattgcttgcggtaggtagaagttttcccacgttggtgtatcaatttgagaaacttgttcaatcgtatcacggcattgttgaattaactgctcaatagcaggcacaacgtgttcaggttgaatttgagagaatttaggtaaacctgtgttgtttaaaagtgggtttgacattcgatttcctctttatttgataaaagtgcgacatcttaccattttagcgattattttcattagttgattgtgatttatgggggaagccgttaaaatttcagttttatacaaactgcaaaaaattaaacacaaccgaccgcttaggaaaacgcaatgtctttagatttatcggatattcgacaacaaatcactcaaattgaccgcaacttattgaaattattatcggagcgtcatcgacttgcgttcgatgtagtgagaagcaaagagatcacgaaaaagcctctacgagatatcgaacgtgaaaaacagctgttacaagaattggttagttttgctcaagcggaaaattatcaacttgacccacaatatgtaacgcaaattttccaacgtatcattgaagactctgtcttaacacagcaacattacttacaaaataaactgaatcagaatcaagaaaatgccaccattgcatttttaggtatgcgtggctcttattctcatcttgcttctcgccagtttatgaaaaacagcacggcttctttagtggaactcagttgcgaatctttcgattcagtttttgaaaaagttcagcaagatgaagccgattatggcgtgttgccgttagaaaataccacatcaggttctatcaatgaagtttatgatttgttgcaacatacagacttaacccttgtaggcgaattagcttatcctattaaacactgtgttttaggaacaaacaatgctgattttgcccaagtggataccatttatacccacccacaacctgcacaacaatgtagccaatttattcatagtttagataaagtgcatatcaaatactgtgaaagtagttctcacgctatgcagttagtggctcgtttaaataaaccaaattgcgttgcgttaggtaatgaagatggcgggaaattgtacggtttaagcgtgttaaaaagtggtattgcgaatcaagaaaacaatattactcgctttattgtagtgtctaaaaaaactatcaatgtttcgccacaagtacagaccaaaaccttgttattaatgacgacgactcaacaagcgggtgctttggttgatgcgttgatggtgttcaagcaacacggcattcgtatgattaaacttgaatctcgacctatttatggtaaaccatgggaagagatgttctatgtggaattagatgccaatattcacaatgaaaatacccaaaatgccttgaaagaacttgaaacagtgacgagtttcttaaaagtattgggttgctatccaagtgaaattattgagccagtccaaatcaacaatataagttaggaaatctcttagatattcctagcatgttacttataatggcagctgccaattaatttcttcgactccgtgagaacgaaggtaatcattggtttttgaaaaatggcgacagcctaaaaagccacgatgtgcagagagcggcgatgggtgaggggctgtgagaacgcaatgacgagaacgatcaataaattgcccttttttctgagcatggcttccccaaagcaaaaataccagattttcacgatgtagattgagttgatggatcaccttatcagtaaaggtttcccaaccgatattggcgtgtgaatgtgcttttccttgctcaacggtgagaaccgtatttaacaatagcaccccttgttttgcccactcaatgagatagccgtgtgatggtatttgaaacccaacatcttgggataattctttgtacatattaaccagcgagggaggcggaacaattcctggttttactgaaaaagataaaccgtgtgcctgattggggccgtgataagggtcttgccctaaaataactaccttcacatctttgaattcagttaaagcaaaagcactaaacacttcattttgaggtgggtaaattacttttccaactaaacgttcttgatgtacatattgcaaaatatgttgaaaatagggttgtgttttttcttccccaatagcatcagtccaactgttcatattctatcctattattaaattgttaaaaattaaaatgaactgttaattcctgtctattttttaagccactatcagtttttttgataaaaatgcttaaatttttctcgctttttaaagggttaaagttaaaatgctcaaaattttttgaaattttaaactttttttataatttacccaacatactaggagctaaaaatgatcaaaggtgtacaaatcactgaatctaccaacaaaaacttattaaactctttctggttattagatgaagagaaaaatgaagcacgttgcttagtagctaaaggtgatttccaagaagaccaaatcgttgcaatcagcgaattaggtcaagtttcataccgtgaagtcccagttaatgttgcaccaaccattaaagttgagggtggtcagcacttaaacgtaaacgtattacgtcgtgaaacattagaagatgcagtgaaaaaccctgagaaatatccacaattaactatccgtgtttctggttatgcagttcgttttaactcattaacaccagaacaacaacgtgatgttattactcgtactttcactgaaagtttataattacatcttttctcaggccctaccgtaaggtagggctttattgtatctattttgacatagtagcagatatgttttctactatatcattattttaaacccaatttcttctcaagatagtggatattcgttccacccttgcagaagttttcatcagaaagaatctgtttatgaagtgggatattggttttaattccttccacgatcgtttctgacaatgcattttccatacgacgaattgcaatatcacgattttcagcaaaggtaatcaatttaccaatcattgaatcataatgcggtggaacagaatagcccgcataaatgtgagaatcccaacgaacacctaatccacctggaacgtgtaaacgggtgattttacccggtgatggtaagaatgtacttgggtcttccgcattaatacggcattcaatcgcgtgaccacgtactttaatatcttcttgtttaactgagattggtaaacctgcagcaacacgaagctgttcttttacaaggtcaatacctgtaatcatttctgtcacagggtgttccacttgtaaacgggtattcatttcaataaaataaaactcgccattttcaaataaaaattcaaatgtacctgcaccacgatagccgatttcacggcacgcattcgcacaacgttcaccgataaattgacgtaattcaggggtaatgcctggtgctggagcttcttccaccactttttgatggcgacgttgcatagagcaatcacgctctgctaaataaaccgcattgccgtgtgtatctgcaagcacttggatttcgatatggcgtggattttcaaggtatttttccatataaaccatatcgttattaaaggctgctttcgcttctgctttggtcatcgcaatagattcttccaaatctttttcgtgatgaaccacacgcataccacggccaccgccgccaccagatgctttaatgatcactggataaccaatcttttgtgcaatttctttatttttggcgacatcattaccgatagggccaccagagccaggtacacaaggtacgcctgcttttttcatcgcattaattgcagaaactttatcgcccattaaacgaattacatctgctgttggaccaataaagataaagcctgaattttctacttgttctgcgaagtttgcattttcagataagaaaccataaccagggtgaatcgcatcagcaccagttacttctgcagcggcaataatcgcaggaatatttaagtaactttttgtcgatggcgcaggaccgatacacactgtttcatccgcaaggagaacgtgtttcaactcacggtctgccgttgagtgaacagcaaccgtcttaatgccaagttcacggcacgcacgcagaatacgcaatgcaatttcgccacggtttgcaatgacaactttttttaacataagacaatgtccttaggtgaacaagcggtcacttgtttgcaaaatgttgcaacaatctgaccgcttgtaagaaatgaattattcaataatgaagagtttttgatcaaattcaaccgcttcgccatcgtttacaaggattgctttgattacccctgctttgtctgactcgatacggttcatcattttcattgcttcaacaatacaaagtgtatcgcccactttcacggttttacccacttcaacaaatggtgcagcttctgggcttgggctacggtagaatgtccctaccattggtgaaagaatagcgtggccagctacttccgctgtcggagctggagctgctgcaggtgcggtttgagctgctggtgcaggggttgcaataggtgctggagcagcttgcggtgctgcaacatattgtactgccgcaggcgcaactgctggggcggcacggctgatacgtactgtaccttcttcttcagacacttctaattcagtaatgcctgattcttcaactaactcgataagttttttaattttgcgaatatccatagtgagatccgtatttcagtgtaaaaataaacagactctatgttcaaagaacatagagcaaaattttgcgtagattacctgaaattttattaatttgcgacgaaaatctgataaatttgccgaatttgttagcaaatttgctactgatcgtagcagttcagttttctttttttacttcaggcaacaaaaagtggatttatttcccactctttagaaattgaatagcataatctagcgcataatcgtaaccttttgcccctaagccacagatccccccttttgccacatcgcttaaataagagtggtgacggaaaggttcacgagcatgtacgttggatagatgaacctcaataaaaggaatagcgacagataataaggcatcacgcaaggcgacgctggtgtgagtaaatgcacctgggttgataataataaaatcaaccttttgaaagccttgatgaatgcgattaatcaatggttcttcaccatttgcttgaaaatagtcaaacgcaaagccttgtgcttctgcttgttgttttaaatgttgttcaatgtcagaaagggtttgtgagccgtagatatgcggttcacgttttccaagcatatttaggtttgggccgtttaatagtaagatggttttcataactttcctttttataataaggtgttcactaactcaggcggtctgcaaagttttgtacctttctgaccgcttacaaatggtcggtttagtagattaggatatttggcaatcaaggcgaaaatatcgttgtcactcatttctggggtaatctgttgataagcctctacattggtacgaatggcttctcgaacagataatccgctttctgtaataagtcgtttaattacggtaatatccagaggcacgttgagatactctatgattatcggttcaatacctgccgcttgaatgatcgcaagtgtttcacgagatttgctgcactttgggttgtggtaaatagttagcattttattcctctgattttcgatcttttctaaacgacaccatcagttgatcgatcttgaagttttccgtatcaataatttcaaacttatatttatcgtacagtacaaaatcagtctttttcggtacttttcgtagcatatacatcataaaaccgctgatggtttcgtagttttcttgatttgggaaggcttcaatatctaaggctcgcattacatcttctaacggtgttgagccatcaaccagccaagagtcttcatcacggcgaacaatctgctcttcttcattagatactaattcgcccattacaatactcatcacatcatttaaggtcacaatccccacgactaacgcatattcattaataatcaccgcaaaatcttcacccgatgatttaaacagttctaacacttcaaacagcgaaagagtatcagggataaacaatgccttgcgtaacacacgactatcgatcaatttaacgttttcttcctgtaaatagagcgtcaataaggtgtgagattcgacataacctaaaatcttatccaaactgccgtcagtaataatcagtttggaatgggaattttctttcagtgtttcaataatttgctggcgattaaaggatttatcaagaaaaacaatatactcacgaattgtcattgttgaagtcactgttcgctgttgcatatcaaaaatattttcgatcagataatgttcttgagctttcagcactcccgcttccgcacctgcatcaacaatagcaacaatatcatcagaagtcatagtttcttcacgaacagtcggaatacgaaatagtctaaacaaagcattcgcaagcggatcaagtaacaacacaaatggcttaaataaaataatgctaaatgacattaaattaaccattttcattgccactttttcagggtttgcaatcgccaaacgttttggtattaaatcggaaaagataatgaacgccactgtcaccaacgtaaaagaaatccacgatgacgccgtttctagccaagcgacttggctgtattgagaaagaaaacgataaatataaggggtaagcgaaccctcgccgaacataccgcccaacaccgcaatcacattttgagcaatctgaactactgtaataaattgcccaggctcttcttgaaacttcaatactttctgtgctttctcattaccctcgttaattaaattctgtaacttaagtttacgcactgaggctaaagagatttccccagcagaaatgattgcactggcgatgaccaataaaataatgattaagatcgattcagataatcccataattgatatacgttaatttaaaaattgcacaagattatagcaaagctagggattaggggcaaaaatagcaagcgggtaaatgagcaagacactttgcaaaaagcagctctcatctaaccacttgctacatattgaaaggaacaattttaccttcttgagtaatcaacattgcctttttgcaacgtttaaacatcggtaaatccatcatactatcggaataaccaacgtcaaactgaatagcaggctgaacacgttcatcaagcattttgaccttattttccgctaaacagcgttctttaagcaaaattgcaccatactgatgaacaaggctagagccaatcaaatgtgcattcggctgttgaagcaaatcggcataaaaatgggaaattaactctacagggctacccgagataatccaaatttgatcttgttgagcaaggtgttgatgaagtgcttgttgaacctgaggtaatggcgttaggctaaagtagtctttgaaatcaacaagatacttctccatttgagatgttgaacaaccaaaggtaatgagaaagtttagaatatttaagctccatcttgctgttgggaaaaaggcataaatcattgatgcaagcggatagacaggcaagaaaatcagcaaattgaggatacgctttctgagtagaaatctcataaaggcgaattcaatatcttccttatgcaatgtgccatcaagatcgaaaaagatatatttcataggattttcaataaataaagggaggtagaacctccctaacataacgactattcttcaatagaacgtaataaatcgttgatacccactttaccacgggttttctcatctacctttttcacgatgacagcacagtaaaggttatatttaccatcttttgacggaaggctacctgaaaccaccacagaaccggcaggaacacgaccgtaatggatttcgcccgtttcacgatcataaattttggtggattgaccgataaacacacccattgaaatcacacagccatcttcaacaatcacaccttctacgatttcagaacgtgcgccaataaaacagttatcaccaataatcgttgggttagcttgtaacggctctaacacaccgccgatacccacgccacctgataaatgcacgtttttaccgatttgcgcgcaagaacccaccgttacccaagtatccaccattgtaccttcaccaacataagcaccgatgttcacaaatgatggcattaacaccacgtttttctcgatgtgtgaaccttgacgcacaacggcacctggaacagcacggataccatctgctttgaactgctcttcgctatatttaccgtatttggtcggcactttgtcgtagtatttagtttctgcaccatcaatgatttcgttgtcgttgatacggaatgaaagtaaaaccgcttttttcacccattgattaacaacccattcaccatcaattttttctgcaacacgcagtgaaccattatctaatcctttaatcacttcttcgacagccgcacgagtttgtgcatcaacagtttttggagtaatttcagcacgacgctcgaacgccgcttcaataattgcttgtaatgacatttgcatttccttcttgtaagttaaataaaaacggcgaacgttttaacatataagcggtgggattgctactaaatttcaccaaataatgtaatagatacatataagcggcatgattctacggattttttacaaatccagattttctctttgactagttgcttcaaaatctgtaatattcgcaccctatgcaaaaggtaaaactacccctaactattgacccatataaagacgctcagcgtcgaatggactacgaaggctacatttctgcgaacctacttagccgtttgggtgaatctgttggtcaagtgctgggcgatgcacaagttactttatcgttatatgttgatccgcaaaaactcacagtggttaaaggcagtgcgaaagttgatgtggagctagactgtcaacgttgtagtaacccatttacgcaaacactcgactgcacattttgtttcagtccagtgtctaatatggatcaggcggacaatttgcccgagatttatgaaccaattgaagttgattcttttggtgagataaatttgctagatatgatagaagacgaattcattctgtcattacccctagtgccgatgcataccgatgaacactgtgaagtgtccgaaagcgaattagtttttggcgaattaccagaagaactggcaaagaaaccaaatcctttcgcaatattagctaatttaaagaaaaactagatctagtaggagtatagccaatggctgttcaacaaaataagaaatctcgttcacgtcgtgatatgcgtcgttcacacgatgcattaaccacagctgcagtatctgtagatgcacgtggcgaaacccacttacgtcaccacgttaccgctgacggttattaccgtggtcgtaaaatcaaataatcaattggatctcgtagaggtttaaattgactcatctaactcttgcgttagatgcgatgggcggggactttggtccccgtattactatccccgcattatcacttgcgttggctcaacatccaatactcagttgcatcttgttcggcgaccaagctgaaatatccccctatctcaataaactttctcccgatattcaacaacgtatcgaattagtccatacaacaaaagtgatcgaagcagacttgccttttgtgcaagcgattcgtcaaagtaaaggcagttcaatgcgtttagcgattgaagcggtagaaaatggaaatgctcaaggctgtgtaagtggcggaaatacaggtgtactgatgggactggcaaaacaattgattgaacccttgccaaacattgatcgtcccgcattaacatctttgattccaacaatcaacggcaactcaagtgtgatgttagatcttggtgcaaacgttgaagcagatagtgaactattgcttcagtttgcggaaatgggcaatgtgtttgcagaagtgatgttggatttggtctatccacgtttagcgttgctgaatattggaacagaagagcataaaggaacacagcaaattcgagatgctcaccagcaattaaaacaatgtaatcatctaaattacattggcttcttagaaggggataaattaatgaatcatcttgctgatgtaattgtctgcgatggatttagcggtaatgttgcacttaaaacacttgaaggtgcggcaaaaaatatcctttcactctttaaaaaaacaacggaagattcacatctttgtcgcaataccaaacgttatttactacgtttaatcttttatcgttactataaaaagctacaacagatcaaccctgatcgccataacggtgccacactgctcggcttatcgtccgtggttgtaaaaagccatggtggggcaagtgagcgagcgtttttctatgcaattgattacgccaaacaacaaattaaaaataacatccctacaaaaatctcccaaagacttattctaaacaattaagctcgctgtatcacaggtaaagttttattcagaaaaaacttttcttttttttaaaaatcgctactatacgccgtcctcaaatataacccaacatttgaggcgttgtttccaacctatccaatcctagggagcaatagggtaaaaacaaaaaagctgaaacgctttttttaataagtagcgagtcaaatgccccaaggcatcttatctttcaagataagaaagcttaggcttcccgcaaggcacccgacttatttttttaacctcttatagaaggtctattttcaaatgacaacaattcctgtaaatccgatcaatcaagcaactaacgaatattacttaactcgtcaaaacgaaatggaatcgaatgttcgtagttatcctcgtaaattaccgcttgcaattgcaaaagcacaaggttgctgggtcactgacgttgaaggtaacgaatatttagattgcttggctggtgcaggtactttagcactcggacataatcacccagccgttattcaggctattcaagatgtattagcaagtggtttaccgcttcatacccttgatttaactacgccgttaaaagatgcttttaccgaagaactactctctttcttcccgaaaggtgaataccgtttacaattctgtggcccttctggtgcggacggcacagaagcagcaatcaaattagcgaaaacctatacaggtcgcggtaatgtaattgcattctcaggtggctaccacggtatgacccacggttcgctctcaatgacaggtaaccttaatgcgaaaaatgccgtgcaaaacttaatggcaggcgtacagtttatgccatatccacacgaataccgttgcccattaggtatcggcggtgaagcaggtgttgatgctttaacttactattttgagaactttatcgaagatgttgaaagcggtgtggtaaaaccagcagctgttattcttgaagcaattcaaggtgaaggcggtgtggttaccgcaccagtgaaatggttacaaaaaatccgtgaagtaacgaaaaaacacggaattgtgttgattttagatgaagttcaggcagggttctgccgttcaggtaaaatgttcgcctttgaacacgcaggcattgagccagatgttgtggtaatgtcaaaagctgtaggtggtagcttaccgcttgctgtacttgcgatcaaaaaagagtttgacgcttggcagccagcaggacacacaggtacattccgtggtaaccaattagcaatggcaacaggttatgcgtcacttaaaattatgcgtgagcaaaatctggcgaaaaacgcagaagagcgtggtgcattcttaaaagcagaattgcaaaaactagcacaacaatatccgtgtatcggtaacgttcgtggtaaaggtttgatgatggggatcgaaattgttgatgagcgtcagccacaagatcgcatcggttcttaccctgcagatagcggacttgctgcggaaatccaaaaagcctgctttaaaaacaaattattgttagagcgtggcggtcgtggcggtaacgttgtgcgtatcctttgcccattaatcatcactcaagcagaatgtgaagagatgattaaacgtttcagcaaatcggttgccgatgcgttgagcacagtgcgtggataattcgttaacaagcggtcgggaattgcaaaatttttaccaaatgtgaccgcttgtagggtgcgtgtaaacgcacctttcgtctattaatacggtgcgttgatacgcaccctacgagaaaagaaaaatggctgatatttcaaaacacaaacaagccctattctgcaatgacgctcaatctattgcagactaccaaagctcaatggaaaccgccgtacaagcggtgagtaactggctacaaaatgaaaaaatgtacaccggcggtagcattaaacagctacgctcagaaattgcctttaacccatcaaaagaaggcttaggcgttgctaaatccttagatcgcttaattgaattattcctcaacaaaagtttaaaagtacaccacccacactctttggctcatttacactgtccaacaatggtcaccagccaaatcgccgaagtattaatcaatgccaccaatcaatcaatggactcttgggatcaaagcccagcaggttcattaatggaagtgcaactcatcgagtggttgcgtgaaaaagtaggctacggcaaaggacaagcgggtgttttcacttctggtggtacgcaatctaacctaatgggcgtattacttgcccgtgatgcgtgcattgcaaaacactggaaaaatgccgacggcacagaatggtcagtgcaacgtaacggtattccgcctgatgcaatgcaaaaagtaaaagtggtttgctcggaaaatgcacacttctctgtgcaaaaaaatatggcaatgatgggaatggggttccaatctgttgtaactgtaccgtgtaatgaaaatgctcaaatggacaccaatgcgttggaagcaaccttagccaaactttatttagaaggcaaagttgtggcttgcgttgtggcaacagcaggcacaacggacgcaggggcgatcgatccactcaaagccattcgtgcgattaccaataaattcggtgtttggttacacgttgatgcggcgtggggcggtgcattactgctatccaatgaatatcgccacttcctagacggtatcgagctcaccgactcaatcacccttgatttccacaaacacttcttccaaagtatctcttgtggagcgtttttattaaaagatgaaaacgaataccgctacatcgactacaaagcagattatctcaactcagagtatgacgaagaacacggcgtaccaaacttagtggcaaaatcactacaaaccacccgtcgttttgacgcattaaaattatggtttacggtggaagcccttggtgaaaatctttacggctcaatgattgaccacggcgtgaaattaactcgtgccgttgcagactacatcaaagcgaccgacggcttagagctattagttgaacctcaattcgcttccgtgttgttccgtgttgtaccgcaaggctacccagcagagtttgttgataccttgaaccagaacgttgcagatgaactctttgcccgtggcgaagcgaatatcggcgtaaccaaagtgaacaacatacaatcgctaaaaatgaccaccttaagtccaattgctaccttagaaaacgttcaggctttattagctcaagtattgagtgaagcagagcgtatcaaagatgcaattgcaaaaggtgaatatacaccggcgattgattaaacataaagagtttctaggatgatgaataaaaattaatttatacgctataaaacgaataagaaatcatcaataactcttttatttagttcatttttagttaaattcatgctaaccctataaaatagatgacaccctattttatagggtaattttttatttatccctaagatttaaacaattagtaagctgataggaaaaagatgacaaacagcagattgcgtactaccatatagccaaattttattagataacgagttcaaatgatgcaccgtagatttcaaaccattgcgattgtcggcaaacctcgtcacgatatagctttagaaacgcatttagctgtgtataactggctaaaagatcgtaaatataatgtgttagtcgaagaaaaaattgccactcaactcaatttagctaacccgatgagcattgcagaaattggcgaatgggcggatttagtaattgtgattggtggtgacggtaatatgctgggtatggctcggcaattagcgaaatatcgtgtaccactgattggcattaaccgtggaaatcttggttttttaacagatattgcccctcaaacagcctttgagcaactgcatagttgccttgagcgtggcgagtttatgattgaagaacgtttcttacttgatgcgaaaattgagcaaaatggtaagatcattgaagcaaataatgccctcaatgaagttgtcgttcactctagccaaatcgctcgtactattgattttgaagtgagtattgatggcaaatttgctttttcgcaacgttccgacgggttaattattggaacacctacaggttcaaccgcctattcgctttccgccggtggcccaatcttaacccctaatttaaatgcgattgctcttgttccgatgaacccacacagcctttcttctcgtcctttggttgtcgatggcgatagtgttatttcaatgcgttttgctgagtacaatcagtcaaatttagtgattagctgtgatagccaacgtttactgccgtttagccctgatgaacgtattcttgtgcaaaaaagcccggataagttgcgtctattgcatttaaaagattacaactactttaatgttttaggttcaaaattgggctggttgagtaagttattttgacataatatgtttcaaaaaattggcatagcgactattttgtctactatgccccaatattgctgggaataatcccctaaatgatttcttaaaattttaatttttgtacgactatcgtataacatcagaagttgcatttagcgcctgacgctgtgcttcaaacaactgctcaatccctttctgtgctaaatcaaggagttgcaataattccatatggctgaacggttcaccttcggcagtgccttgtacttccactaaacgaccgtcttcaaccatcaccacattcatatcggtttctgcgttagagtcttccacatattccaaatcacagaccgcttgcccatcgacaatccctacagaaattgccgccactaatcctttcatcggattttctttcaataagccatcggcgatcaatttgttaatcgcatcgtgtaacgcaacgcaagcccctgtgatagacgctgtgcgtgtaccgccgtcggcttgtatcacatcacaatctaccgtaattgtacgctcacctaaggctttcaaatcaacgactgcacgcaaagagcgagcgattaaacgctgaatttccattgtacgaccgccttgtttgcctttcgccgcttcacgttgggttcggctatgggttgctcttggcaacataccgtattcggctgtcacccaaccttgttgttgccctttgagaaaacgtggtacagtttcttcgacagtggcattacacagcactttggtttcaccaaattctaccaacacagacccttcggcatagcgagtatagttacgagtgatttttacaggacgagtttgatcaacaggacgattatttggacgcatatttattccctttctctaaaaaatttcccctattctagcagaataccaagtacaatatgccaaattttgtaacaaagagaaaagagtacaatgatttacagtatgaccgctttcgcccaccttgagcttaaaaaagagtggggtaacgccgtatgggaaatccgttcggttaatcaacgttttttagaaacttatttccgtctgcctgaagcctttcgcaatttggaaatgaccttgcgtgaacgtctgcgtacgacactaacccgtggtaaagtagagtgtagtttacgcattgaattaaatgctaatcaaaacaatggcttagctttaaatcaagagtatgccaaacaggtgataagttcattacaatggctaaaagaaacggctcaagaaggcgaaattaacttggtggatattctgcgtttccctggggttgtcgataaccaaaatcaagatctcgaccagatcagccaagatttattagacggttttgagcagatccttgtagaatttattgcaatgcgtggacgtgaaggggcgaatttacaagccttaattcaacagcgtttagacgctattgccacagaagcaacaaaagtacaggctcaaatgccgagcgttttacagtggcaaaaagaccgcttgcaacagcgttttgatgaactgaacttgcaacttgatccacaacgtttagagcaagaaatggtactactggctcaaaaagtcgatgtggcggaagagttagaccgattacagctacacgtcaaagaaaccacgtctattttgaaaaaaggcggtgcagttggacgtaaattagactttatgatgcaagagctaaatcgtgaagcgaatacgctggcatcaaaatcgattaacgctgatgtcactaattctgccgttgagttgaaagtgttaattgaacagatgcgtgagcaaattcagaatttggagtagtcaatgagtcagaccttaaccccatttcatacctttcatttgcctgcaaaagcatcggtcattatcgagttcaacagtattgaacaactattaaccgaatggcaaaaagctgatcacgcacaacaaccgattttattgttagggcaaggctctaatgtgctgtttttagatgattttgacggcacagtattagtcaataagctcaaagggatcgagcatcgtcaagatgagcattttcattatttacaggttgcaggtggtgaaaattggcacgagttagtgcaatggacattgcaacaaggaattggcgggcttgaaaatctggcgttaattcctggtgttgctggctctgcaccgattcaaaatatcggggcttacggggtagaatttgagcgtgtttgcgattatgtcgatgtactaaatctcaaaacgggtgagctgttccgtttaacgaaaaacgagtgtgagtttggctatcgagaaagtgtattcaagcatcaatatcgtgagcattatgcgattgtggctgtcggtttgaagttggcaaaggtgtggcaacctgttttaaattacggttctttggcacaatttgatccaaacacagtaacgccacagcaagtgtttgatgaagtctgtaccgtacgccgagcgaaattaccaaatcctgatgagtttggtaatgcgggtagtttctttaaaaatcccgtagtggaatttgcaaaatttcaacagattcagaccgcttacccgaatattccacactatccacaagcggatggttcagtcaaattacctgcaggctggttaattgaccaagcaaatttaaaaggtttccaaattggcggagcggcagttcatacccagcaagcactggtgctgattaataaagagaatgcaactggggctgatgttgtggcattagcaaaagaagtccgtcgtcaagtccgtgaaaaatttggcgtggaattacacccagaagtacgttttatgggacgacagggcgaagtggatagtgaatttgtgacaaggtaattggcaatgggatttgatcaacatttaattacatcggcattaacccaaggacaagctcttgtatttaaagagattgactctactaacgaatatctactgacgcactataaaaccttaccgtcaggctcactttgtgttgcagagtcccaaacggcggggcgtggcagacgtggacggcagtggtattcacctgaaagtcaaaacgtttatttttcaatgttatggcactatccttcattggatattccacagctctcatcactaagtttagtggtatcagtattaattgccgagaccttccaaacactgaacgtaccgcatattcaaattaaatggcccaatgatatttactatcaaggtaaaaaaatggggggcattctaattgagagccgtgtcgataaaacgggaatttaccttgtgattggcatcggcttgaatttaggaatgaacgctgtcgataaaaatgtggtaacgcaggcttggagcgatctctcagaacatcagatagatcgttcccaactggttgctgagctagctaaacgtttacaaaatgccctagtgacttatccacaaaccacctttgaaccctacgcagaacgttggcaacagtttgatattttccgtcatcaagcggttagattaatcactgaaaatgaagaaattcacgggatttcccttgggattaatgaagaaggggaattgattctgcaacaaggggaaattatccgccgttttgcgacaggtgaaatgtcattgagaggaaactaatcgtccctatctcaattcatattttagggatgccgtaatcaaaagagttagtgaaagttagaaaaacagaaccaacactttggtccactatgcttttttaggctgtaaaaatagttatatactttctagttgcttgcttcgttgaaaaatgaattgaattaacatattatcaacatctatcactacttttcccttaaatacatgaaagcactattcatcttactcggttttatctcaatcatattaggtttaataggtattattgtacctgggctacctaccaccccatttttgcttttagcactctattgttttggcaaaagttctgaacgactaacacagtggttcttatctaccactatctattccaaatatctcaagtctttcgatcaaacacgagcaatgacacttaaacagaaaatcagtattttggcattttctgttccgttctgtatttttgcgttctttgtaatccctcatatcatcggtaaactgatcttaattgctgtgattatctttcaatattattacttcatctttaagattaagactttagaaaaataggctctcaaggtaaaataacaagcagtctaaatttgtaaaaaagagaaagaaaatgcccgcttgtttaagcaaagaaaccttaaaaattggcttagtttccgtatccgaccgagcatctgcaggtgtttatgccgatcaaggcattcctgaattacaggcttggctacaaactgccattaccacgccttttgaacttgaaactcgtctaattcctgatgaacaagcggttattgagcaaacactaattgaattagtcgataacctcgcttgtcacttagtcttaaccacaggcggaacaggccctgctaaacgtgatgtcacgcccgatgcaaccttagccgttactcaccgtgaaatgcctggctttggcgaacagatgcgacaagtgagtttacattttgtaccaacggctattctctctcgtcaagtgggggcaattcgacatagctcactaattttaaatcttcctggacagccaaaggcaattaaagaaaccttagaaggcgtgaaagatcaagatggcaaagtgcttgttcgaggtattttcagtgcagttccctactgtttacaacttttaagcgacatttatattgaaacttaccctgaaatttgtgagagttttagaccaaaatcagcaagaagataggataacttatgaaaaaaattgaagcgattattaaaccattcaaattagatgatgtccgtgaagcattaacggatgtgggaattacgggaatgacggtcactgaagtcaaaggttttggtcgtcaaaaagggcatacggaactttatcgtggagcagaatatgcgattgatttcctgccaaaagtgaaattagaaattattgtggctgatgagcaagttgatgaatgtattgaagcgatcattgataccgcacaaacaggcaaaatcggcgatggtaaaatctttgtgtataatgtagaacgtgttattcgtattcgtacgggcgaagagaacgaagaagcaatttaacgagtgaattgttatttgttggatttttcaagctcataagttttcttaactaaggaaaataaaatgtttaagagtttaactattgaaaattttagtgcgtttaatcaggcaacatttgatttttcaaaaaacatcaatgtgtttatcggcgaaaacggtacgggaaagactcatgtaatgaaactgatttactgtttacaaagtagtagtcagtcagaaatagatttgagacaaaagctcgaaaatgtgttttgtgtgaagaaaggagtaagccgtttagttcgtcgaattcaagggacgaatacttgtgaaattcacttagaggagagagaaagaagaaaagtttctcttatttttgataatactcgtgcgaatcgttttgagcttttcgataataaacgcccaaatagagagcttatgtctcccgtttttattcccgtaaaagaagttctttcttttgcaccggggtttatctcattatatgataaatatgagttggcatttgaagaaatctattatgatatagtaaaacaagcctatttacctactcgtaaaggtattcctttagagaatgaagtcccactgttagaattgattcgcaaaattgtgggtgggcgagttaaaattgtcggcgatgaatttcaactatcttctcgtggttctaatttagaaatggttttagttgcagaaggacatcgtaaattagctctgatttggcaactcattcacaatggttcactatttagaaataacacattattttgggatgagccagaagcaaatcttaatccatcattaatgcctgaagttgctaaaattttagtaatgttagcggaacgaggtgtacaaatttttgtgtcaacacacaactatgcctttttgaaagaattagaatttgctaaaaaaaatacagatattgctttctttagcttggagaaaaataaagaaaacggggtcattgtacgtaaatttgatcgttatattaatattacaccaaataaaattgcagaagagtatagacgaatttatcaagaagagataaagagagaattaggcggttaaaatgaagctgaaagaggagcagaaagattggattgagggtgatctctattttgatttttctaacgcagataagacactcaattttgataatggtggtaaaggacacggattgcaacgagttttcaaatcggtggactttattgtagaagacaaagatacttattactttattgaaattaaaaatccagaagatacaaatatccctgaaaagatgaaggctcggcagatcgaatcttttaaagagaaattaaaaaatcaaaccttacataaggatctatataaaaaatttataggtagcttactttttcaaagtttacaagagggaatcccgaaaaagaaatttgtgtatgctatttatttaggactatctaatctggatgaggcaatgttatcccagatgaaagatgatttcattcgttcaagacccttaataaaggaaatagctaattttagatggaataaaggctttgcgattcaattttttaattttaaaacttggaatattaattttccccagtttaaagtggtgagaacaaaggatagcaaattatgaattttaagttaatcaaaagaaattctctttcttggctttggctaagttttattattatcattgttgatctttttacgaaatatcttgttgtacaaggctttgatctttatgaaagcgtgaatgttctgccgttctttaatcttacgtatgtgagaaactatggggcggcgtttagcttcttagcggatcactcaggctggcaaaaatatttctttttaggtttagctattgtcatttctattgcattgattgtaatgctgtttaaaaataaagcggagctcaaactgcaaaattcagcttatgccttgattattggtggggcaataggcaatgcggttgatcgtgcttataatggctatgtggttgattttttagatttttattgggacatttatcattatcctgtatttaacattgccgatattggtattgtggtgggggcaggattgctgattttagaatccattttagaacatcgtaaaagtaaaaagagtaattaaatgaacattattttagcgaatccaagagggttctgtgcaggtgtagatcgtgctatttcaattgtagagcttgcacttgaaattcacggcgcaccgatttatgtgcgtcacgaagttgtacacaatcgctttgtggtggacggattaaaagccaaaggggcgatatttgttgaagagcttgatgaagtaccagacggtgctattgtgattttctctgctcacggcgtttctcaatccgttcgccacgaagctaaacgtcgtgagttgaaagtgtttgacgcaacctgcccgcttgtaaccaaagtccatatgcaagtggctagagcgagcaaaaaaggcacaaaagcgattttaatcggacacgaaggacaccctgaagtcgtcggcacaatggggcaatatgataatgagaaagggggtattttccttgtagaagatgtggaagatattgctaaacttggcttaaaagaagatgaggatctgacttttatgacccaaactactttatctatcgacgataccagcgatgtgattgaagccttaaaacagaaataccctgcaattcaaggtccgcgtaaaaatgatatttgctatgccactacgaaccgtcagcaagcggtgagagaattggcgaaattagcacagttagtgctagtagtggggtctaaaaactcgtccaactcaaatcgtttagccgagttggcttctcgaatgggaacaccgtcacagttaattgatgggccgcaggacattgatccgaactggctacaaggggtaacaactatcggtattactgcaggtgcatctgcccctgaaatattggtgcagtcagtggttgaacacttaaaaacattgggtgttaccaaagttgaagaactggaaggttgtgaagaaaataccgtatttgaagtgccaagagagctacgcattacggaggtaaactgatgaatcgttttagaattgaatgggaatgccgtcgaggtatgcgtgaattagataaaatgattatgccgttttatcaagaacattttgatagtttaaccgctgaacaacagcgcactttcgtggaaatgcttcgctataccgatcccgaactgttccgctggtttatgaatcaagacacaccgccaacagaggcattgcaagagatggtgagattgattcaatcgaaattggtctattgagtaatgatatgtaggtaaagtatttagcatgttagataaaatggttgtttataatccctgtttgtgtgtgggaaaacccaaaagaactatagaaatattttctttggagctaacgttgatcagcccctattattaagacttatatcattatctaaatgaaaaaagaaaaatccgaatttcccttggcacaatctcgtgtcgatgccccttttgccaaaggcgtattggcgtggtatcagcaatacgggcgtaaacatctgccgtggcaacaaaataaaaccttgtatggcgtttggttatccgaagtgatgttacagcaaacccaagtggcaacggttattccctattttgagcgttttgttcaacgttttccaaccattgttaatttagccaacgcaccgattgatgaagtgttgcatttatggactgggttaggctattacgcaagggcaagaaatctacataaagcggcacagcaaattcgagatgaatttggcggtcagtttccgacggattttaccgatgtatttgcactttcaggtgtcggcagaagtacggctggggcagtgctgtcttcggtacttgatgctccgtacccgattttagatggcaatgttaagcgtgtgctgtctcgttatttcgcagtcgaaggttggtcgggcgaaaaagcagttgaaaataaattgtgggatctgaccgctcgtgttacaccaacttcgcaagttgcggattttaatcaggcgatgatggatttaggggcaatgatttgcacacgatctaagccgaaatgttccctttgtccgttagaaaagggctgtcaggcaaatgctcaacaggcttgggcggattttcctgctaaaaaaccgaaaaaggtgttgccagaaagacagagctactttttgattttaaaacaggggacaaaagtcttattggaaaaacgtgaagcaaaaggactttggggcggactttatgtctttccgcaatttgagcatttagatgatctcaagcggtcagtttcaggcagaaatgtgcaatttacccaattaattgcctttcggcatacttttagccattttcatttgggtatttatccgattctggcggaacttagtttacaaagaaatgccgaaatcttaccgcttggagtggcagaaaatcagggaaattatcatttgcgtgtatcttcaacagcggattattggtatgatttaactcaacctagcgaagtgggtttagcaaccccaataaaacgcattttagacgaattaactttgacattaggacagaaaaatggcgcgtaatgtattttgtgcatatttgaaacaagaagcagaaggtttagattttcaactttatcctggggaattaggtaaacgtatttttgattcaatcagtaaacaagcgtgggcagagtggatcaaaaagcagacaatgttagtcaatgagaagaagcttaatatgatgaaccctgaacatcgtcagcttctggaaacagaaatggtgaattttttgtttgaaggaaaagaagtccatattgaaggttatgtgcctgtagagtcaaaatagagataacctaatgaacaaatataaaaaattcctgccgttattggtgctgatcccttttttagcatcttgtggaagtgatacgccgacgagaaaaggttctaagaagcctcgccctgattattctaaaaataccaatggattagatattttgatggggcaattttcgcgtaatatcgatcaaatttggggcgttcatgaactgctccaagcaagccagaaagactatgtaaaatatacggacaaatattacacccgtagccatattagttttgaagatggtcaaattaccattgaaactttggcggatcataaccgcttgcgtaattcgattattcacacattattgatgggatcagatgctacagggatagatttatttgcttcgggtgatgttcctattagcaataatccttttttagcaggtcaagttgtggatcaatatgggcgttctgtaaccaatatggcggttgctaatgattttgcaacttacctattgcaaaataaattaaaaacacgccgcttgaaaaatggacataccgttacttatgtcacgattccaatgattgcaaaccacgttgaagttcgtgcaagacgatatttgccattggttcgtcaaatgtcaaaacgctatggcattgatatgagcttaattctgggtattatggaagttgaatcagcatttaacccttatgcagtaagttatgcgaatgcgattggtttaatgcaagttgtacctcgtacagctggacgggatatttttgcgcgtaaaggttttggtggccagcctaatcgtgattatctttataacccaagtcagaatattgatgcaggcacaatgttcttaacgattttgcgtgatgagtatctagaaggaataactgatcctacatcaaaacgttacgcaatgatttcagcatataatagtggggctggcgcagtactgagagtgtttgataatgacaaattaatggcgattgagcgaattaataacttagatccgtcagcaatttatcgaattttaaccaccgctcatccatcttcacaagcaagaaactatttggttaaggtaaataaagcccaacaaaaataccgtaacgtgagataacacgttgttttttaaacaaattgaataaaaagcgatccgttaaacagatttttttatttttttgaaaaaaacgtttgacgagaggggcggaaatcagcataatgcaccccgtaacgacgagatgcctcgatagctcagtcggtagagcaggggattgaaaatccccgtgtcggtggttcgattccgcctcgaggcaccatttatgttacaactcttttcctccttagttcagtcggtagaacggtggactgttaatccatatgtcgcaggttcgagtcccgcaggaggagccatatttttagccccgatgagaaatcatcggggcttttctttttctctctatacctaggcatagtagaaaaatggttgctaaaaagtggcttaaagccttatagtacaaggatttaagcccttttttaaataaccatctgtcttctttcacaaagaaattacgtctgatagatatttagattgattacacaagtaaaacaaacctataaacaattagcagaaaggtatcaatgtttcattagagctactcaacattattttgcataaaaagaacagtagataccataatgttaaattttccccatccctctttcgggcccttccccccgtttgtgggggaaggggttaatgagtaataaactaaggttcgatgaaagtaagcaggaagtttggtagagagggaactatctctccaacgctatcgccaacaaagtaatcgggtgtaggcaggttaagttggtggacatatcaatttgccatttacaggtttcgcactcggaaacgacatagtcaaaaccaccgttattgatgtgttggaacaacggattgccaatggcttgtgaagtttcatagttttccgctttgaagccgtaagtccctgcaataccgcaacattgtgatggtaacatcacaatttcaatccctgggatatgttttaatacatcaagggtgtaaggcgcccaacctgctttatcaacgtgacaagcggtgtgataggcaatgcgtaatggcatctgtttgaattttggttttttgccttgattaaacagttcatagagatatttggtgacgatatgaacgtgtgggcggactttggcgttgtccattcctaaaacgtgatgatattcgtcacgcaaattcattgtacagcttgatgatgtccctactacgtcaagctctcggttcatcaccactttttcaagttctgcaaggttgaatttcgcttgttgcttcgctctatctgggaagccgtttaccattaatggcaaaccacagcacttctctttttcaagtagcattacgccgatgtccatcgcgttaaacacatcaatcaactctttaccaagttgtggattgttgtagttcacataacagccgtgatagtacgccactttttcacgataaagggcttggcgttcttgctcttttttcatataccagttgcggaatgaaccaaaagcgtattttggcaacgagcgatgacggctcactttgatggttttttcaagcaagaatttggttgcttttagacctgtgatggtattgacaatcggggctaatggggtgttcattttgcccataatgtcggtgttgctcaaaatagcatcacgcagtttgtgcattagcggtttgttttggcgatctaaatgacggtttctcgctcgcacaataatgtcaccaattttgacatcagacggacaagctacttcgcaacgtttgcagttggtgcagtatttgagtgcttcatcataaagttcagggctttttaagcgtaaacgctcaccatctgggcctgattgtttcggacctggatacatcgggttattacgcgaaacagggcaaaccgccgtacaagcggtacatttaatgcaactttcaaaggactcatcaaaaccgtgatgaacaacggcagaatgggtattttgttgagcttgttcgattaaacgttgaatgttgttcatattatgcccccacaatttcttctgcaacggcaagtgccgttgccactgccacacctgagccacagcctaattcaaggctattaaaaccgccaatgacgttgccagttgcatataaattcgccataaattgcccatctttgcgaacttggcatttttcattgatcgcaacccctgccgattgatacggttgtggcgatgaaaagcgattagccgtccacgacaagcggtcagtttcattgaaatctttgcaaccaacaatatcggcttggaacactggttcaaaaatgcgatcaaagtttgcttttaagccgttgctgaaatagcttcctgtggcgagtacaaaatgttctgcactgatcgcattgtcttggtgaagctgggtataaatccgttgtactttgccattttcaatatcggcttttaatgctctgtcgccgtttaacatcaaaccgcccaagcgttcaaaacggtggcgaagttgtttatgttggcgaataccgagcaatgatggcggtaaggttggtaattcaaaaatcgttgcttccaccgcttgttgtaactggttgaagaaactttgatcgtccaagccaaaacaagctggtaagaagatcgcttctgcccctttggttgccgttttgatttctgccacaagatcacggaaagccaatttgtgttctaacacttgagcgatattcacactacggaactcacgagcattgttacgcagttggtcaagctctggaatgttgagatagccagtgcttaattcgcagtgggtaaattgtgggttctgttttaggttatcggctaacagttgtggttggaagtcgtgatagccttcgatccccaatatcgcaattgttttataggggaaaggttcgctacctttgactgttggcacactgtttggcgataaccacgctccacgcaagctacctaaaggcgttactcgtaggtgattttgtgcggtagagccgaccaaatcgagcttgagcgatgtggcgagttgttcaaattgtgtcgctttggcaaggactttctctttgccgagtaagctgtaagggtgttgtggcaactgttttgcgaaagttgcataggatttgcaaaaatcagcgacaaactcaccgcttggtaaacggctgagtaaatccattgaacccgatgagaaatcaatcgccgcttgaccattgttgataatcacacaacgtttaccctgttcttgtagggcaaccccacaggttaagcttgcaagaccgccaccgataatgactacatcaaaattcattgctatctgtcccctgttgagcttgctctgcaagcggtttcacatcatttagacctaataaactgtaatagatccagctagtaaaatcggcttctcgaatggcatcgccccacgcaatcggctcaatcccacgccagcgttcttccataaaagaagccagttgagtggtagattggcgtggtgttgccacttcaaaacgggtcatcagcccagcggcacggcaggcacagagttctgcttggcaagttcccattccaacacgggtacggcgacgtagatcgacaagattattgacacttaactcgtccaccgcatagcgaacttcccctgcggtaaccgcttcacactcacaaaccagagagcggtcaagacgttctttatccaacaggcgagtagctcgagagccgtgacgataaactgcagaatagcgaatggtacttggcagtgaaatgacttttctgttggtttccgctcggctttcacttgaaccaggtaaggctttttctgcagtaacacagcggtcggttttgtttaattttttgcaaacgagatccgttgcccactcagccattaagcgataggtcattaacttaccgcctgtaatagtaataaagccttctaagccatcacgctcttggtgatcgagcaagacgataccacggctgacattacgtcctgatggatcatcatcggtagccactaacgggcgaaccccagcgtaagcacgcaatacacgggtatgtcttaaacttggtgcaagtttttcgccttctctaaagagaatatcgacttcttcaggggtgacgatcatattgtcgatttgatcgtaaggaatacggcttgatgttgttccgataacgctgatagtgtcgcctggaacaagaatatccgcatcggcaggcttacggcaacggttgatcaccattttgttgatacggtgtcccatcaccagcaatgcgcctttggcagggaacattctgattttcaaatcggcatattcagcaatgccttgtccccaaataccgccagcattcacaaccacaggggcaaagaattgacgttccactctgtttttatggtcgtaaacgttcacgccaatcactttaccaccttcacgaattaaccctttcacttcgcaataggtaaagactttcgcaccattctctgtggcatctaacatatttgatgctgtgaggcgaaatggatcaatggaaccatcaggcacaaccactgcaccgacaagagctggatttaccgaaggctccatttgcatcgcaagttttggatcgatagccaccgcttcaatgcctgactccgtacaggcttgaataaaggttttttgatagtcgagatcatcttcaggcaaagtaataaacaacccttccgtttcatcaatacagtggcgagcgatcttgcgtagaattttgttctcttcaatacattctctcgcagactcacgatcattaaccgcatatcttgctccactatgcaacaaaccgtgattacgtcctgttgcccctgtcgcaatatctcgacgttcaagcaaaatacagtcaatgccacgcaatgcacagtcacgagcaatccctgcccctgttgcaccgccaccaatgataatcacatccgtcgttaagggtgaaaaatcttccacatttttatacatatgaggtgatatcttcattgttacccccacaaaacaaacaaaaataaattaaattgttgatattctatccctaatcaacatttttaaacaagaaaatgagcgaaaaagaaattaaatttgtgataaagctcacatttatccaaatgtgctgagcaagttttgtgaaatagctcacaaaatgaagaaatacttctttttaattttcaaaaaagggatattatgaacaacgacaaggtctggatatgtttacaaacaaagcagaccttatttgtctataaactttattgttggaggctctatgtttggtccttttaaacccgctccgcatatcccggagctaccaaaagagaagatagattccacttataaccgcttacgttggcaagtgtttgcagggatcttctttggttacgcagcatattatttcgttcgtgcgaatttcgatttagctcaaaaaggtttaatcgaagcaggaatgtacacaaaagcagaacttggtgtgatcggtactgcagcaggtttagcttacggtttgtctaaattctttatggcaaccatttcagaccgctcaaacccacgcgtattcttaccgtttggtttgttactctctggtctttgtatgacaatgatgggcttaatgccttgggcaacttcaggcattttagtaatgtgggtaatgatcttcctaaacggttggttccaaggtatgggttggcctccgtgcggacgtacaatggttcactggtggtctaaatcagaacgtggaaccatcgtatctatctggaactgtgcgcacaacttagggggtatggtaccaggtacgatggtgttacttgcaagtgcaatctacttcagcaactacggcgtagaagcaaccgctaaagacgtatggcaacaagcgttgtactatccaggtattgctgcaatggtggctgcaattccaatctatttaattatgcgtgacaccccacaatcttgtggcttaccgccagttgaaaaatggcgtaacgactacccagatgactataacgaaaaaacctatgaacacgacttaactgcgaaagaaatcttagtgacttatgtgttaaaaaataaattgttatggtacatcgcaatcgctaacgtattcgtttacttaatccgctatggtgtattgaaatggtcaccagtttaccttggcgaagtaaaacacttcaacatcaaaggtactgcttgggcatataccatctatgaattagcagcaatcccaggtacgttactctgtggttgggtatctgacaaactattcaaaggtaaacgtggtttaacaggcttcatctttatgatccttaccaccgcagcagtagttgcattatggatgaacccagcaacaccagaagcagaacttgcacaatacgcaggcaaaggctggtatgaaaacccatatcaattaatggacttcatcttaatgaccacaatcggcttcttaatctacggcccagtaatgttaatcggcttacacgctcttgaacttgcaccgaaaaaagcagcaggtacagcagcaggtttcacaggcttatttggttacttaggtggtacagtatctgcatcagcagtggttggttgggcagcagagtactacggctgggacggtggcttctatgtaatgatcgcaggtggcgtattagcagtattgttaatgttcatcacaatgcttgaagaaggcaaacataaagcgaaattagaagatagctatggtaaataattaacgattaaaaggaagacattttggtcttccttttttatatctacaaaaagaggaaaacagtatgaaactcacaaaatttgcattaggtttagtcgcaacagcagtattagcaggttgctcaacatcaaccccagtcgcaacacaatcagataaattaattatcgctcaccgtggtgcaagtggttatttaccagaacatactttagagagtaaagctcttgcctttgggcaacaagcggattatttagagcaagatcttgcaatgaccaaagataatcgcctcgtagttattcacgaccatttccttgatggtttaaccgatgtcgcgaaaaaattcccaaatcgtgcgagaaaagatgggcgttattatgtggcggatttcacgttaaaagaaatccaaacccttgaaatgaccgaaaacttcaaagtagaagatggcaaacaagttcaagtctacccaaaccgcttcccaatgtggaaatctgatttcaaaattcacacctttgaagacgaaattgaatttatccaaggtttagaaaaatccacaggtaaaaaaatcggtatctaccctgaaatcaaagccccttggttacaccaccgagaaggtaaagatattgcactggaaactttaaaagtgttgaaaaaatacggttatgaccaaaaatcagaccttgtttatctacaaacctttgacttcaacgagttaaaacgtatcaaaaccgaattgttaccaaaacttggtatggacgtaaaacttgtacaattagtggcttacactgactggcacgaaacggaagaaaaagacaaatcaggtaaatgggtaaattacaactacgactggatgtttaaaccaggtgcgatggcagaagtagcgaaatacgcagacggtgttggaccaggttggtatatgttgatcgacaaagagaaatcaaaagtaggcaacattgtttacactccattagttaaagagttagcccaatataagatggaacttcacccgtacacagtacgcaaagacgcactacctgagttcttcaccaacattgatgaaatgtatgatgccctactcaacaaggctggtgcaacaggtgtatttactgacttccctgatactggggtggagtttttgaaaaaaaggtaaataaaaacgggttagactataaattttttaatagccctcactatctatggatgtagtagtgaggttgattagattattttaccctcaacttcgccaacacggcttttagttgtttatccaacggtgctgtcacgaccatttcttcgctcgttttggggtgaacaaatcgaatagaatgggcgtgtaaaaataaacggtttaaacccgcttgttgcattttttggtcaaattcacggtcgccgtatttatcatcaagggcaattgggtgtcctgcgtattgagtatgtacacgaatttggtgcgttctacctgtcacaggcgaagccttgactaaggtcgctatcggataacgttcttcaattacaaatcgggtctcggacggtttgccttcttcacttactcgtacaatacgttcaccactggctaattcgtttttcaatagcggtgctttaatcactttaacgtgcgattgccactgcccacgcacgagcgcgagataatctttctgtaccactttttcacgcaactgttcgtgcaaactacgcaatgcggaacgttttttcgctactaacaacagccccgatgtatctcggtcgatacggtgaactagctctaaaaaacgggcttgtgggcgtaacgctcgtaaggcttcaatcacaccgaagctcaaaccgctaccaccgtggacggcaatgcctgacggtttgttaatcactaacatcacttcatcttcataaagaatttgatgttcaagctctgcaactttgttgagtttggtcgaaatcggtgcttcatttttttctgccacacgcacaggcggaactcgcacaatatcgtccgcttgcaacttatattcgggtttaatccgccctttgtttactctcacttcgcctttacgcacaatacggtaaatcaggctttttggcacgcctttgagcttggcgagtagaaagttatccaaacgttgcccagcttcatcatcactgatcgtaaaaaattgaacgctggcactaattactttttctgttgtcattttgatataaagaaaggaaaaatgaattggattttatcacaaattctgtctcgtgttagaataggctgaaattgatataggagaacataatgagtaccacagaaaaaacaaaagaaatcatacctgaaatcactttaccccctgaagcgaaagagattattactgatgtaaaaaatcttgaacttcaacaattcctggaaaattggattattccctatggcactaaattgttaattgcaattgcgatttttgttatcgggcgttatttggcaagggttatcagtacccttatcggcaaagcggtattagcatcaagcaaagatgaaatgctacaaggttttgttcgatctatcgcttattttctgtttttgctgattacagtgattgcctcactttcacaattaggcattaatacgagttcgttagtggcattgataggtgcggctggtttagccattggtttagccttgcaaaactcattacaaaactttgctgctggggtaatgctattaatctttaaaccatttaacaaaggcgattttattgaagctggtggtaaatcaggcaaagttgagcaaatggggattttgatgttggagctaagaacggtcgataataaaacggtgttgatcccaaacggtaaagtatttgccgacagtatcaccaactactcccgcaatgaaactcgtcgcatcgacttcattttcgatattagctatgagtccgatattgagaaagctaaagagattattgctcaaattctgtttgaagatgaaaatgttttacactatccagagcctaccattgcagtcggtaacttagcggcaagcagtgtgcagttatttgtgcgtccgtgggtacagacgaataactattcaactacacaatttgcgattttggaaaaagtaaaaattggctttgataaggctgggatttcgattccgtataatcagttagatttacatttgcctgagcagacctcggtaacctttactaaatagtgaatcctaataattaggggaaaaaatatattctgttttccataaatagaatattattttgtgagttccccgctatttatagtggggctcatagaatttttcaggttatttaggtattattttttccgattataaatttccttagccttaggcactaaacgtgctaaattcgcttggcgatcttcgtttgacgggtgagtagaaaaaatagacaaacctgaactgccgttcgcttggctcattttcacccacacatttggtgctgcttcggggttataacctgactctgccattaacatcaaaccgacttcatcggcttctgtttcttgactacgagagaagggtttattggcaactaaatccacccctgcactgagcagaccctctgtatctacccctgttgttgcggtcactgcaacatcagcaagtacaccaacaatacctgtcactgcgctaacagtacgatctgatttgccatgttcttgcaaagcgtgagccatttcatgtcccatcacaaccgcaatctcgtcatcagataaattcaacttatccaccagccctgtgtagaatgccatttttccaccaggcatcgcccaagcattcaattcacttaatttcagcacaatgatttcccattgaaacggcacacctgttttatttgctcgttccgcataaagcttcatcttattgaaaaccgaatgaatgcgatgagctgtcgttgagctagtatctaacatactttttgctcttgcttcctgcttcactttagcataattactttctgcttcttgattaatttgggctgtgctaacacaagcggttaaaagtagtgaacaaattgctataacgctaagattcttgaaaaatttcatacttaattcctatcataaaaaatgccaaagcgtttactttggcattatattcggttaatagtttaattattttttcgcacgttcgaaagactctaagatctcttgacgagcttcattcacatcgccccaaccttcaactttcacccatttgcctgcttctaatgctttgtagctttcgaagaagtgttggatttgtgcttttaataatgctggtaagtcgcctacatctttaatgtgatcgtactctttggttaatttgctgtgtggaactgcaactactttcgcatcgccacctgcttcgtcagtcatttttaacacgccaactggacggcaacgaatcactgaacctggttgaagtgggtatggcgttggaactaatacgtccacaggatcgccatcagaagaaagggtatggtttacataaccgtagttcgcaggatagaacattgctgttgccataaaacgatccacgaaaattgcaccactttctttatccacttcatatttgattggatctgaatttgcaggaatttcaattacaacataaatatcatctggtaactctttaccagcaggtacattttctaagcccattttggtttccttctattaaataagggtgaaaaattggcaagattataacggattcattgccaatcagcaaagcaagcggtggttttacagcaaaaatttgtaaaaataactctaaaacctatcgcttgtgtaggtggaggttctaatgctttaggtttatttaacgcatttattgatgagccctctgtcgcactagttggagtggagccagcaggggaaggcttggataaggctgggcgacacgcagctacaatgacaaaaggaaaattcggtcaaatgcaaggctttaactgctattacttgcaagaagaagatggcacaccatcagccgttcactctattgcttcaggcttagactatccaggtgtcggacctcaacactgctatttaaaagatgttgggcgaggacgctatgaaacagcaaccgatcaagaatgtttagaagcattcctcagcctttcacgccaagaaggtattatccctgctttagagagtgctcacgctgtggcttatacgttacgtcgagccaaggaactaggaagcgataagcgattattggtgaacttatcaggtagaggcgacaaggacactgattttgtattaagtaaacttaccttataaacaaaaatgtaattgcgtaaattgaaataacaaatcctaataatatcaatttacgcaatcatcaaaatccgtataattctcgccataataattacagtatgtaaacacaacatcaaacattcaacattaacaacacaggatttttattatggctaactatttcaacacattaaacttacgtgaaaaacttgaccaattaggtcgttgtcgttttatggatcgcagcgagttcgcggacggttgcaacttcttaaaaggcaaaaaaatcgtgatcgtaggttgtggtgcgcaaggtttaaaccaaggtttaaatatgcgtgattctggtctagatattgcttatgcattgcgtgaagaagcaatcgcagaaaaacgtgcatcattcactcgtgcgtctgaaaatggttttaaagttggcacataccaagagttaatcccaactgcagatttagtgattaacttaaccccagataaacaacactctaaagtggtggcagatgtgatgccattaatgaaacaaggcgcagcattcggttattcacacggtttcaacattgttgaagaaggtgagcaaattcgtaaagacatcaccgttgtgatgacggcaccaaaatgcccaggtacagaagtgcgtgaagaatataaacgtggtttcggtgtgcctacattaatcgcagttcaccctgaaaatgacccgaaaggcgaaggtatggcgattgcaaaagcgtgggcaagtgcgacaggtggcgaccgtgcaggcgtgttagagtcttcattcgtagcagaagtgaaatctgacttaatgggtgagcaaacaatcctttgcggtatgttgcaagcaggttctatcgtgtgctacgacaaattagtggcggacggtaaagatccggcatatgcaagcaaattaattcaatacggctgggaaaccattaccgaagcgttaaaacaaggcggtatcacattaatgatggatcgtctttctaactcagcgaaaatccgtgcctttgaattagcggaagaaatcaaagaacagttaaacttcttatatttaaaacatatggatgacatcatcagcggtgagttctcatcaactatgatggcggactgggcaaacggcgatgcaaacttattaaaatggcgtgaagaaacaggcaaaacagctttcgaaaattcaccaaaagcagacggtatcaaaatttctgaacaagaatactttgataacggtgtagtgatggttgcaatggtaaaagcaggtgttgaaatggcattcgatgcaatggttgcaagcggtatctacgaagagtctgcatactatgagtcattacacgaacttccgttaatcgcaaacactatcgcgcgtaaacgtttatacgaaatgaacgtggttatttcagacactgcggaatacggtaactacttattctcacacgttgcaacgccaatcttagctgagaaattaatcccaatgttacaaaaaggcgatttaggcgaaccaacgccaaccgttgaaatcgataatgtgtacttgcgtgacattaacgatgccatccgcaaccacccagttgagctaatcggtcaagaattgcgtggttatatgacagatatgaaacgtattgctgttggtgactaatttttagtgataaaaaagcctgctatggaaatagtgggctttttgtgtttggtttaattaatatgggaatagtagacaaaattttcaattccgttgatgtgattttgtttcactgtaaacagctccgaatggttaattcgttcgtggtgaaattcgcttacatcgagggcatcataactacgataagtatcggtataaccccagctgtcaggcttgattttccttgctataacaggcattagcgttgttgttttcgtatcattgacgaccacagtaaatacttttccttgccgtttcaatatcccaaaaacagccacttttcctgctgctccacgacctcgttttcctttacgaggtccaccaaaatagctttcatccaactcaatttgtcagtcaaatacttcatctgcttcaagggctaaatgattactgatgacctcacggatttttcggtaaaacaggatggctgaattgggctgaataccgagtaaatctgcggctcaaaataagatttcaatttattgttctaaattaagaaaattattaaaaatattatgtgtgaaaatagcgaaaatacagtcatattttcaactgcttggggataaaatgatagaaattccatcacctattattcttcttgtaatgattattatagaaagatttatttttcggaacactgttgataagtaaaaacagtaccataagtaatcggaaagcaggagtgctaaataaataaccaaatttaactctaccacgctttcccttcaaaactctccaccaaaaaatcaatcaattttcttacggcaagggggagtttgtcccttgacggatagatcgcataaatgctgaatgtcggcagttgccaatcgggtaggacggcttgcagtttgccctgttgcagttcggtttccagcatatattttggcaacatcgcaatgtcgctcccgtctagcacagcgttgagcagtgcttgggtgtcgttggtagtgaaacggctgtttaagtcgagcaatacttctcgctctccttgcgtacatttccacgctttgcggttggtgttatggtgcgtcagcgacattgcaaaaactcaatgaaatctatccgcttaccttaacgccaacaggcttgttttaccaaagcggtcgtaaaatggacgcagatttcgccagctatgcgtggggtaacgaccaacggattgaaaaattgaccggtcagccgtttagtcaggcgtatttggaaaacgtgctgcaagggcaaggcgagtttaattcggcaaacagcttactggctttaacagcggtgcaacaaattgctccagaacaagagcttgctgtgttgtcagcgttgcagacggcacgttatgtggacggtttggataatgcagattttgctgtggttgaacaggtgttgcacaagctcaaccttagccaagctgtgtcgttgcttagcaaacaatctacccaaacggcattagcacaacgtcttcaattcgggcaacaactcgcccaccattgcggtgtgcaaggtgtgccgcagttgattgtggaaaaagatgaacggttgcatattgtgccgagccagttgttgtatggggctggtgtaagccttgtggactatgtgcgacggctttaataaaaaacgtaaggttttattgcaatagataaatccctaaacaacacagttacatttaatcctatgtcgtactaaaataaatctatttagtacgatataggattattttatgactttttacaaacacattttcactcggtattatttgaaattggagcaatggcaatcggtgcggttgcagtattattggctggggatttcagccttgaagctgcggctggcacggggattgcaatgtctgtgatggcaatggtacttaatttcttctttaactatgtgtttgataaaatttttaccggcaagcgggaagaacgtagtctaaaattacgcattttacataccgtctgctttgagtgtaccttattgctgtttaccattccggtggtggcgtatttattgaatttaagcctgtggcacgcctttttggcggatattggtttgagcttgctgattatgctgtataccttggtgtttaactggctttatgacatcactcgtgtcaaatttttggagcgtaaaaatgaacccctttgataaattggtggagctagcagcacagctgtcgagcatttatgctagtgtagcgaaacaacatcagctcaccttaaatgaattgcattttttgtattccattggtcgctatggtgcgacttcacctactgctattggcaataaatggagtttgccgaaacaaacggtaacctctgtttgtaaacaactagaccaaaaaggttttttggcttttctgcctgatgagaacgacaaacgcagtaagttgattgctttaagtgcaagcggtaaaatttttatcgacccgattattgctcggttaaccgaagcagaattgcaagtcacgttgaagctcgccctgatattttccaagcgggtaagcgcaaatacagcgatgaagaaattttagccttaatggcagacgaacaaaaaccgatctttgtgtatgaagatgaaaacggcacggtgcaaggctatgctttctgcatttatcaaattatgcaaggcattccagccttatttgatcgcaaggtgttgtacattgacgatttctgtgttgatgcgtcacaacgaggcaagaaaatcggcgagaagttgtatcagtatatggtggactttgccaaagcaaacgcttgcgacagtgtgacacttcacgtttggaatgacaatcaaggggcattccgtttctatgaacgcttggggcttgaaccgttaaaaaccttgatggagcagaagctttaggggaaaaagcggtgggattttgacgagattttgcatttgcaaacttttcttcaaatcctaccgcttgtttaattaacctagcatattgttttaacctttcacttgttcaaacaaccactcacggattggctcaatagtataagccactcgccacgtattgcggtgaccgcttgcgccttttttgtccgctcctggaaggaaaaccgtgtctttggcgaaaacagtgtaattgattggattaccttgtgcgacgattttatcgtaggcaaaacggtattcgttagcgttccagcgagcgtcccaaatttcacgactgatttttgccccttctttttctaatttttccgtgatggcgttttgtccttggaatgcacctaaatcatctgcggagactaaaatccaaagttttttcttcgcaagcggtgcaaccaaatccgctccccattgacccgcgactaagaagcacgccgcaaataaatcgggatatttgatgttcattgcaatggccatcatacagccgccggattgccccgtagagtaaatgcgattgccgtcaatgttgtattgtttacgcaagctgtcgattaaatgaatcgtggtctctaacatcggtgaggcttgagatttatcgtccacgataatttcatcaaactgtggcgcaagcacgaagcaagggcgtttagcctgatcttctggactagcccacgaaattgcacctaaaccttgcaataaagtcgctcggtgaaattcactggttacaccggcatcgtgcataaacagcactaacggcaaaggtttgtcgccgtgatttttcggaacataaaggttgtaacggagagattttcccgtttcaggatcgttaaaggtgagctgttggaaatcgtccacaatcagattttttaccgaagaagtcgaaagtttcgtgccgtcggcattaatggttgcggtcggatcattaaaaattaaattagttgctggtttatcgcctgccacccaaggtttaccgccccctgctggttttggtcgaactgttgcatttgccattggaatcatttccgataatgacaagtttgcatcatcgggagaaagttgcacaatcacaaacttgcccgattctgctttatctaagctagcagaattactgacaaatacattagtaatcgtgcgtccttcaacgctgaaatcttttgcgtcaaactgaccgcttgtgacaggctggctgtattcaatggcaatggcggttaaacgcacaccattaccaaaaacttgggtaattgccgtagccgtttgcggtttcgcaccagtgttagctagggtaggaaagctagcaactaaggctgtaccagcactcataattaaaaattctcgacgagataacatattactttccttttgatttagtgaatttgatagatatagactataaacttgtcaatgagtttagcattttatcattataaaaataaatttatcacggttggggaaataatatgtaggcggtaaagagacataatggtaaggtagtatttttaaatgacggagaaaaatatggatttccaacacattatcgaacgctcgcaagccattcgggaaaaatatcatcaactagaacgacaaaatcaccaaaccgaatggtcggtgattgaagatgccttagcctttttgagtgatgccggattagtcggtcgtttaacgatgtcgcaacaagaacgctgggtttcaaataaagatgtgacgccagaacttaaacataaattggctgaatgtatttggtggcttgccgtgctttcaaaacgaatggatatagatttaaaacagtctatggaaacttttttatcaggtatggaacaacgtttggggaaataacaaaacaacaagcggtgagattttgcatatttgagacaatcccacagctttgtgttatcaagtcctcaccaacctactcaccacctgtcctgctgttttttctttaactacctgccaatgttcaggcaagaccaacggcgagtgatttttttcagcttcgacataaatcaaggcgttttcagccagccagccgttttgttcaagtgccgttaagacttgtggtacaaagccttgatgaaatggcggatcgacaaaaaccagatcaaaaggtgcctcgctatttttctgtgcaagaaattgtaatgtgtccgtttgaatgaccttgccattttcagcttttaggctgactaaattctttttgagttgatttgccgcgtctgcaaatttttctaagaatacgaccgcttgtgcttgacgggataaggcttcaatcccaagtgagccactgccagcaaagcagtccaaacaacgagagccagcaatatccatcatcagccagttaaagagcgtttcttttactcggtcagtggttgggcgtaatccttcggcgtttaatacgggcagttttcgtcctcgccataaaccagcaatcacacggacttcgcctgttggtctgttttgtgtagaaattcgagtttttttcatacgaaatcgtaaaaattagggttaaaaatgatagactaatacaagtttattccatttttatcgaaaatggattttttaattttaagagagagcaaaaaatgtcagatgaaaagaagaaaaaaggcttttggtcttggttaggtttcgggaaaaaagaagatgttgaacaaacggaaacgaccgaagaaaaagtagaagagaaagcagaagttcagccagaggaaatcaccgaacgagcggtcagttctaagcaatattttgcaaaagatgaagaagttatcgaagaaaatataacaaccgaaaacgtgactgaagtcccaactgaagttgtcgaagatgttatcgttgaacagacggcggaagaaacagttgaaactgtcgagcaagcggttgttgaacccaccgcagaaactacagaaaactcagatgaacaaacggaagagttgcaaatttctgagcaaaatccaccgcttgtcgaagatgaaagtccagtcgaagaacgtgttcaggcagatgaatatcaagaaaaaccaaccagcgaaggcggttttttcagccgtttaatcaaaggattaatcaaaacgaagcagagtatcggctctggcttccgtaatttctttagtggtaagaaaattgatgatgagttgtttgaagagctagaagaacagttattggtggcggatttaggtatgccgactaccacgaaaatcattaaaaatttaaccgaacacgccacaaaacagcaattacgtgacgctgagttgctctatcagcagttaaaagttgaacttgccgatgtgctgaaacctgttgctcagccattggtattggaagataaaaaaccttatgtgatcttgatggtgggggtaaatggggttggtaaaacaactactatcggtaaattagcacgaaaattccaagcggaaggaaaatcagtgatgttagcggccggcgatacgttccgtgcggcagccgttgaacagcttcaagtatggggcgaacgcaataacattcctgttgttgcacaaagtactggggctgactctgcgtcagtgatttttgatgcaatgcaatcggcagcagcaaaagggattgatgtgttaatcgcagacaccgcaggacgtttgcaaaacaaaaataacttaatggacgagttgaaaaaaatagtgcgagtaatgaaaaaatatgatgaaaccgcaccgcacgaaattatgcttacccttgatgctggtacaggacagaatgcgatcagccaagcgaaactgtttaatgaagcggttggtttaacggggattaccttaacaaaactggacggtactgcgaaaggtggggtaatttttgcgattgccgaccaattcaatattccaattcgctttattggggtgggtgaaaaaattgatgatttacgcccatttgatgccgaagactttattgaagccttatttactcacgaggacgagaagtaatgatccgatttactaatgtcagcaaagcctataaaggcggtggacgaccagctctgcaagggattaacttccaccttgcagaaggggaaatgaaatatatcacggggcattcaggggcaggaaaaaccaccttgctgaagctgattatgggcattgaacgagccaatggcggacaagtgatgttcaacggacacgacattacgctccttgcagaacgagaattgccgtttttacgtcgtcaaattggtatggttcaccaaaattatagcctactgagcgaccgctcgattttagataatgtagcattacctttgatcattatgggcgttaatcaaaccgttgcagaacgtgaagctcgccttgctcttgctcgtgttggcttggaaaataaagcgaacttccgaccgcttaatctgtcaggtggggagcaacaacgtgtagatattgctcgtgcgattgttcatcgtccgctgttattacttgctgatgaaccaacaggcaatttagacgacaaactctcttttgaaatttttcgtttatttgaagaatttaacaaagcaggcacaacagtattgattgccacccacgatacaaacattatcgcccaacgccctaaaccgtgtttagagttggaagaaggacatttaaagtaaggatcgacaatgctaaattcacttaatgctcaaacccgttttattctgcgttcagtgtggcaagatctactcaaacgtaaatttggcactttcttaacggtattagttattacggtgtccttaacgataccgaccgtcagctacttgctatggaaaaatacgagccacgcagcgacggaattttatccagagccagaattgacggtctatctacataaaaacctagcagaacacgatattaatgcagttgttgaacggattcgtcagtttgataccgataaggtggactctcttaattacatttctcgccaacaaagcctagatgagtttcgttcttggtcaggatttggggaggcattagatattttagatgacaatccactaccagccgtggtgctcttaaagccgaaaaaaacctttacctcacctgaaaatatgctggaacttcgcaatggtttgcagaatattaaaggggtacaggaagtgcgtttggacaatggttggttagaaaaacttacagcgattacccaactcattgctcgtgtagcggtcacttgtacgctgttgatgctgattgccgttttccttgttatcagtaacagcattcgttctgatgtgtctaatagcaaagcatctattgatgtgatgcaactattgggagcgacggatcattttatttcacgcccattcttatatattggaatgatttatggcttgctcggaagcctactagcgatgctatttagtttaatgactatcagctattttacaggggtagttcgttatgtatcagatatgtttacggtaaaatttgaactacacggctttgatgttagtgaggcgatttttattatggcactgagtatctttcttgggtggttatctgcgaagattgcgacgaataggtatattcagaagattggtggaaagtggtagaagcttttatgaaagatagaatagctgttaatttttggcaaagcgatataagaaaatgcgctgcattagagatgtagaggctgtaataaaataggagactgatgtagatcgaccctatcccaaattctgtgtaaacacccatttcaacttaacggtgatcgtctaggcgatcaccacaatcaatcataaatcgattcattgccagtttccagttctgaatcggcattgtccatttttttgatgcttctttaatcgcaagccaaatcactttgaacactgaatcatccgtcgggaatacatttcgttttttaatcacgcgacgaatcacgctattaagcgattccacggcattcgtggtataaatcgctttacgaatatcagccggataatcaaaaaatgtggcaatatttgcccagttatcttcccagcctttcgccacaagcgggtattttgcctgccatttttgcgaaagtgcggtcagattttcacgagcttgtacttccgtcgggacttgataaacctgcttttcaacgatttcctgattacttaaccccttggcatatcaggcaataatctgctcatccattcctgtgatgcgggtttggtttttcttgatagaacccaaggcgattatgcaacgaatgttcggcggtatcctgatggggatcggtgccagctttgcaggcggttgtacgatcaccaactcactggtttcgaccgcttatttttcgtggcaaggttggcttgctacgctgatgattatgctcggctgttggactgcaacttattttgtgaagccgacccaatgtcgaatttaaggaactgcaatgaaacgcaccgcacttttgccattttttcgctctttctaaccgcttgtaacgataacatcatcaagaaaatcgacacgatggaactactggcgaaccttgataatcctgactatgtaattattgatagccgtaacgacagcctgtataacggctttaaagataaacatgccagccgtggcggacatatcaaaggcgctatccaatttcgttgtaactggtttgaacggattgaagctgacaagtttgacagttttgcggaagctaaagggatcagcaaacagaaaaccttagtgatttatgatagcagtcctgatgaattagcttgcatttctgcggagtttaaggcaaaagactacaaagttcgtacttttagcgactttattagctatgccaatgcgggttatccgttagacagttttccccatttccaatatagcgtttcgcctgaatggttgtacgctttaatgcagggggagcgacctgaaacctaccataacaaccaatttatgctgtttgaagtgtcgtggggaagtctggaaaaagccaaagcctacacgcagcatattgtcggggcttaccattttgatacagactgggtggaaggcgaagcccctgtttataaccttgccgatccgcaaaaaattgagaaaaacctgttacagcacgggattaccaaagataaaactattgtgctttattcggaacctgtctgagccgaaagtaattgagcaaaacttactcaatgctgggattaacaaaaataaaaccattattctttattccaataaccaactcgccgcttatcgcattttctgggcattgaaatgggctggcgtggaagatgtgcgagtgttaaacggcaattttgctacttggacaaaagcaggcttcccagctgaaacgaccgttaataccccaactccagtcagtgagtttggtgcagttattccagttaatccacagatcaacatctcaatgccagcagatgcgatggctcgccagcaacaaggtttgaaattaatcagtaaccgagcgtgggacgaatacacaggcaaaatcagtggttacgattacattctaggtaaaggcgaaccacaaggagcaatctggggcttcgccggtagcgactcgtctaatatggtggattattacgaccttgacggcacattgcgtaacccaaatgaaatcttcgcactctggaaaggtcaaaacatcaaccaaggcgatcaacttgcgttctactgcggcacaggctggcgagctgggatatcttggtttatgacccaattagcaggctggaaagatacctacgtttatgacggcggttggaacgcgtggcagatggactcaacgttccctgtacagaaaggcgcgccgaatgagatggtgaagccggatagtaaaaactaatatataaccctcgtaagcggtcagtttgttgcaataatttgtcataatctgaccgcttatgttttcgttctattgcttcgctatataaaaaattatattaaaataaaagaacttttcttcctatatcacagtcttaacaatatatcttttatttttggagagcatgatgaaacgcactacacttacaacactatccttaatagcttcaatatcaacgacttttgctgcccctacaacacagcccgatcccttagctaatttaccttatttcaaccaaactcaagatggctatcagcttgaatttgatgataaaaactaccgtagcttagaaatggtggttaatggtgcaacgattaaattccgagcttttgagaagattgtttatgtcaaaaatccactagaacctgattatcaaaccatcaatttttatgtgccagaagcctattttaacggcggttcaatcaatggatttacggctaacaccgcaccgattttcttacctaatgcggttgggggttatatgcctgccaaagcagcaacctatgataaaaaaggtttcggctcgaatgcagataaaccgaatgcaatcgtaacagcactctctaaaggctatgtggtggcaagtgttggtgctcgtggtcgaacccttgagaaagacggcaaatatacaggaaaagccccagcagcgatcattgacttaaaatcggcggttcgttacttgcattttaacgatcaacgaatggcaggtgatgcgaataaaattatctcaaatggaaccagtgcaggcggtgctttgtcggctctactaggggcaagtggcgatcatcgcgattatgcggaatacttcaaacaagttggggcggcagaagctagcgatgcgatttttgctgtatctgcttactgtccaattaccaatttagaaaacgccgataccgcttatgaatgggaatttaatggcttaaatcaatttagtcgcattgatatgagccgtttatccgcaacaggttacaatgatcgctctcagtcaaaacctcgtattgaaggtgaattaactgcagatcagatcaaaacttctcacgaactaaaagccgcatttccagcttatatcaatagcctgaacttaaaagatgaaaaaggtaattcgcttacccttgatgaagaaggaaacggctcttttaaagagtatgtcaaacagatgatagtgagagcagctgatacagctcgtaaaaatggcacggatttaagtgataagtcgtggctcactttgagtaaagatggtgtggctgatatggattggaacggctatattcattcagaaaaacgaatgaaatcaccgcctgcctttgatgcctttgatttaagctcaggggaaaataatctctttggaacggaaaccgttaataatcaacattttaccccttacgcccttgaacgtagtaccgcaaaaggcggtatggttgatgctcatattatcaaaatgatgaacgcaatgaactacgttgaaaaccctaaagccgcagaacattggcgtatccgtgtaggtacttcagatcgtgatacttctcacgcaatcggtgcaattttagccattaagctcaatatggcaggtaaacaggtcgattatgcaaccccttggggagttccgcacgcaggggattatgatttagatgcactgtttaagtgggcggatagtattgcaaaatagcgtattttaaatagactaaaagttgctaaccactgtaaaagcaagagctagcaactttttctcacacatattgatgttattacgtatttttcatcaatcgtgaaattctcccctcaaaaatttcctcatcacggattgtcataacctcgcagccatcttttgtaacaacaatttggtgttcatattgtgcagaatgactacgatctttagtttttaccgtccacccatctcccatcaggcgtatttcctttttcccagcattaatcatcggctcaatagtaaacaccataccttcttgtaataccactccgccatcatctgaaaaataatgtagtacttggggttcacaatgaaattgatcgccaataccatgtccacaatattcacgaactactgaaaatccctctttttctgcaaattgctgaattgctttaccgatttgatttaaacgaatacctggttttaccgcacataagccaatataaagacattcttgagtaacctctaacaagcgcttatctttaatcgttggctctcctacagcatacatttttgaattatccccataatagccatccttcatcacagtcacatcaatattcagaatatctcctttcttcaatttcttttctggatttggtatgccatggcacacaacttcattcaatgaaatacatgttgcttttggatagccatgatagcctaaacatgcgggaattgctttctgtacttgttcaatatattcatgacaaatgcgatctaattctccagtactaattccttctttaacatagggctcaatcatcactaaaacatcagaagctaacttacaggcaatacgtaacttttcaatctctgcctctgaacgaataggtatattcttcatttttacatctctctacaattaaacaaaataaattatatcctctttagccaaataattcactccatataagtaagcattaccttaatgaatatctatatttgttactcaaccgtcactgacttcgccaagttacgaggctgatccacatcagttcccttaatcaaggcaacgtgataagaaagtagttgtaatggaacagcatagaaaattggtgctgtaacgtgatctactttcgggaaagttaataccgtataaccttcttggctgctaaatccagcttctctatcagcaaagacatacatttgaccgccacgggcacgcacttcttcaatattcgattttactttttcgagtaaatcattttctggtgcaaccacaatcacaggcatatccgcatcaattaatgctaatggaccgtgttttaactcacctgccgcataggcttctgcgtgaatataagaaatctcttttaatttcagcgctgattccattgcgataggatagaactcaccacgtcctaagaagagtgtatgatgtttctccgcaaaatcttctgataatttctcaatctctttatcaaacactaatgcactttcaatttgtgcaggtaagcgttgtaaagagttcacaatttccgtttcttgttcagcagatacattaccttttaagcgtcctaatgccgtggttaacagtaataaacaggttagttgagtcgtaaatgccttggttgaagctacccccacttcaacgccagcacgggtcataaaagcaaagtcagattcacgcacaagggaagagcttgccacattacaaatcgtcattgccgccataaaaccagattctttggctaaacgtaatgccgctaaagtatctgcagtttcgcccgattgagaaatggtaattagcaaactatttggacgagtcacaaatttgcgataacgaaattcagaggcgatttcgacatcacaagccacgcctgcaatagattcaaaccagtaacgagccaccataccagcattgtaagatgtaccacaagcaacgatttgaatgtgttcaactttctttaagatctcttcagcattgttgctgatcgcttcaatatttactttaccgttcgcaatacgtccttctaaggtattcataattgctactggctgttcaaaaatctctttttgcatatagtggcgatattgacctttatccgctgcatctgattcaaagttaccttcgtgaacgtcacgctctactttttcacctgcacgattatagatatcgacagtacgacgagtgatttctgctacatcaccttcttcaagatagataaaacggcgagttacgcttaataatgcaagcgggtcagaagcaaggaaattttccccaacacctaaaccgatcactaacgggctacctgaacgagcaactactaaatgctcaggttcatcttgattcattaccactgttccgtaagcaccacgaagctgtttgaccgcttttcttaccgcatcgagtaaatttggcgttgtacggaattcccattccactaaatgtgcaattacttcagtatccgtttgtgattggaatacataaccgcgttgttgtaattcagcacgaagttcttcgtagttctcgataataccgttatgaacgacggcaattttgcctgaacggtgtgggtgagcattaacttctgatggctcaccatgtgttgcccaacgggtatgtgcaatccctgtgccgcctaaaagtgggtttgcttcaagtgcttcatctaagaatttcactttacccactcgacgaacgatttgtaaattatgattgttccctaaaactgccacacctgctgagtcataaccacggtactctaaacggtgtaaaccatcaactaagatttctgcgacatcacgttgtgctactgcacctacaattccacacataaatttgctttcctatttttgcttaatttgtttgttgtttattttgcaacaatcacctcaacccctaacgcctcaatttgttgtttgacgtttggatcaagctgatcatcagtaattaatttatcaatttgttgccattccaattcaagatttggcatttttcgtccgattttttgagattcaatcagcacaatcacttcccttgacacttcagccattacttggcttaagccaatgagttcattaaaagtggttgtgccacgggttaaatccagtccatcagcaccaataaaaagctgatcgaagtcgtaagaacgcaatacatttgcagcaactttcccctgaaacgactccgaacgagcgtcccaagttcctcctgtcatcaggactgtcggttcgcattctaaagcgattaattcatttgcaagcgcaagcgaatttgtcattacaactaagcccgaatgatgtaacgctttgactaaagcccctgttgtgctaccgctatcaataataatgcgattatgttctcgaatctgattggctgcactatgggcaatggctaacttttgtttcgaaagttgctcttgcgattcttcatttatctctgtcggcaattttattgcaccgctataacgacgcaataaaaaaccgctttcttcaagagcggttagatccttgcgaatagttacttcagaggtttcaaataagtgtgccaaatattccacacttacttcgccttgttcttgaacaaggcctacaataatctgacggcgttgttgtgtatttcgttttgacacttaaattttccaaatatctttcgattcaaaatatgattattatatagaggaataattagcaagagaagtaaaacttgtagcatcattctggatgggagaacactgtaacatctataattaacaaatatcttgcatctataaaatgtaaaggaatagattgaaacctaaaataccaatacccacgctaaatagaacatttcttaaccacgcatagctcgctactactcctactaatgctattatttgagcgataaataaggtataaccttcattacttttcggcaaacttaagctggtgagtaccatcaataccataatcacaagcggtaacattttgtttaatttctgcaaaattggcgaagatagtacagtttttggtaagaataacggcaaaaagcgacaaagttgagtgcctaatgccaatgcaatcaacatataaataatattttgtgtttccattaggcttgcccttttttctcagtgaatgattggggtaagaaagcgacaatgataatggcaatgataattgccacaagcaaaacgcttgtttgtgtgatttgccctgcaagtaaaaatccaatcaatgcaataaaaatcggcttccactgcttttggctactgtattgttcataagctaaaatagcgaataagcaaggcagtgcaaaatctaaattgggaatatattgggaaacagaatcacccagtaaaatgccaacaatagttgcaaatgtccaataactcattcctaagatactgattttgaacatcatcgcctgacgagtttcttgtggtaaggtggttaatacgccaaagttttcatctgtcagatagcttaatgcaaaaaagcggttgagtttttctttgggtaatgatgaatgcatattaagtgtataaaaaataaaacgtaagctcatcaataaagtgctgagaaaaacggaaactactcccgctccagaaacaaaaaagggaattgctgcatactgtgctgtgcctgaaaaaacggtaaaacacatcacaaccgtaaaccacgctggcattccagcattggttgctaacattccataggcaatacctgcggcaaggtatcccataaatatcggtaaagtgagtttgaatgcactttcccaactattttccgtgttaaatgacatagagctccagcgtaaatttatgcaatgagtgcattttcaaaaaaatacaaacactctcttataacataaacctttataccaaatattaagccagaatataaagaggaccttttactccacaagatgttaacccgattattatcaggaagagcataaatatcagttttttcattatttatgtatgtattgttaattacgttgggtaaatgttacgttagaatagtataaaatgcaaaatcttttaagagagatgttgccgattgggtatttaacacaacaacagaataaaccttaccatgaccctatcccatttggaccaacttatttctgggtatggaatttcgttcattagtgttgaatggttttattcgttattattgaatagttttgttcgtttgcattacacgatttgtaccgttctggaaggtgtttgggaaataacagtaacttattgaggagaaacatagattaaatatagataccataagacacaacaaattttatttcataaatgtgtctaaattaaatgctgtttgtttttgcaaaacagcctgtgcaatagtgactaatttacgcattaaagccgtgataatcaccattttaggtttgccgcattcaagcaatcgaagtacaaacgagcgatatacgctgtttttgtagctgccaaaggcaaagttcattgcagggcaaaagagtgccttacgaatgtcggattgcccgatttttgaaataccaataacggtatttaaactttttcccgaacttttaatcatcggggttaaacctgcaaaagtggcggctgctttcgcgtttttaaaacgattgccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggcaatcatctgctgtgttgaagcaatgcaatcgctgtcaagcaacatcgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgcactgcatttagggttaatcacgctaacggtgatttgctgttggaacagaaaatctgccaaagcttcgtgataaatattggtggcttcgatcacgcagtgaaaagtttcaccaaatgtattgagccattgcataagtgattgaaatccttccggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcaaagcaactctactttctctataaccccattatgaaggtactcgtaatggggttttcttttgcccatattctaatacaaggggcaaatcatatttgccccttttatcaaacctccacccttttcccaatatcctttaacttcgacaactcttccaccaatcttggtgcgtcatctaggctgatggcaaacgtccacagataagtaattaccgcataaatatgccctgcggtaacgccttgtttgagggttaaaaccgtgagtgttacgccaaacagcaggcacattgccacgccgatacacaaaaaactgaacgcttctcggttggaaatcaggatacggaaacgttccaccaagcgataatgtttaatcagttcgctgtttttggcacgttccacacagtccacttctttttcaaggcggttgttgagcttgaaatataagcggtcattgactttcacataatggggcagcaacaagccaaagcctaccacaatcaacaacgccaccacgcccgaccaaaattcaattaacagcaacatcaccactgccccgataatcgaaaacgcagaggtaatcagggtcggtaaatggtgttcaaaaaaattcacgaactcacgggacaacgccacacgcgcggtggtggttgatgtgtcaatgcctttaatccgctggttcaaaatcactggcacagcaagttccgtataaatgcgagtgaaggcacgggtatccaccgcacggcgagccgccccaacgccccaaataatcagcacaatcaaggcgtaagcgagcgcagaaatcagctgcccatttagcaccgcattcaccgcaaaactgcccaccaaaggataaatcaacaacagcagattttccgccgccaccaagccgaatgtgacaaacaagcgttttttatgttgcaaagcaagggttttgagcgaacggagcattgtcggctcaagggtagatgcaacggttgtttcaaggttttctaaagacatcacgctaccttatcggttatctctgttttatcaatttgctcacggcaaacgacacaaaattctgccattaaggcaaataactgctcggtttttcgtttaccaaatttagcaaaaactttatcactgagttgatgtgttgccgcccaaatgggttccgccttcgccttgccgtctgcggttaaacgcatcattttctcccgtttatccaccgcactttcgctaaactcaatccagcctttttccttatattccttgcaaacattaaacactgtctgttttggcaagcaccattcatcgcaaatctgcttttgcgtacactgcccattttccgctgccgccaaagaatacaacactgcataatggttatagcctaagcctaacttgctaatccaagcatccatcgtggcatccatttcattcatttgctgacctaatttatcgaagttgctcattattaaagtcctaaaacttactaaaataaatgctattttagatgtgagaaagagaaaatacaagagatattagtattaaaatttactttgttggtttttctgttttcattgataaaaatgtttttgtcgcctaaatttaaaggggctttaattgtataatatcaatggcggattttagggaacaggattggggtgaatgtaccgttgtatgcatgctcaacaatttagttgaagattattgtagaatatcaaacaaataagaatttctattggataataaaaatggctaaaaaagaaattaaaaccgatttatgggtatatgaattacttaaagaagcgggtatttcattagatccacaaggtagttctatcaaagagttaaatgacgcacttaaaacagcgtccaaatcaggcaaaggcaatgttggctttcctgaatattgtggtgttgtgaaagattttgtcatagtaatagaggataaagctgatactgctaaccatatcaagcacaatgataaagctctaatttgtcaaaacgctacaagtgtgagagatttcgctgtaaatggggcattacattatggcattcacctagcaaaaaatacgagttataagaagattattgctattggtgtatcaggcaatgaaaaacgtcataagatttctccgctcttcattaacgaacgtggagagtataagagcttagaagatgttgaaacctttaccttattcaatgaaaagaatattggagagtattacactacaaatatcttaaaagaacagacagatgaagaaaagaccactgctgaaattttaaaagatgccaaagaattgcatgaagatctacgtaattacggcagtattcaagataaagacaaaccactgattgtatcgggtattttgcttgccttgcgtgaaattgagtataaaaattttgatattgataacttaaatggtgatgaaattaaaactgatggtcagaaaatttatgaagcaattcaagcaaatttagaccgtgctcaagttaagccacaggtcaaaaaagataaactacttagtcagtttttagttattcgtgataccaaagccattaatgaaattaattctacattaggaaaaaccccactaaagtattacactcaatttatttacgatcatatttataagaacatcaaatatattcactctgctgaagactacttagggcgtttttatggcgaatttatgtcctattccggtggagatgggcaaactttaggtattgttttaactcctcgtcacatcgttgaattgttttgtgaactgatagatttaaaaccaacagattctgtatttgatccttgttgcggtacagctggctttttgattgccgctatgcaccatatgctacaaaaaacagataaagaaacagagaaaagaaaaattcgtaaagaacaattacatggtatcgaattgcaaccttatatgtttaccattgctacaacaaatatgattttacggggtgatggtaaaagcaacttggagcaggaagattttcttaagcaaaatccagcacaattacaactcaaaggctgtaatgttggtatgatgaatccaccgtattcacaaggatcaaaagctaacccaaatttattcgaaatttcatttactgagcatctacttgactctctaaccgcagacggcaaagccatcgtaattgttcctcaatcatcaatgactgggaagagtaaggaagagcaggcaatcaaagaaaatattttgaaaaagcatactcttgaaggtgtgatcacattgaataaaaatacattttatggtgtcggcacaaacccttgtattgctgtattttcaactggcattccacatgaaaaagataaaatcgtcaaatttatcaactttgaaaatgatggttttgaagtgcagaaacatattggcttagtagaaacaatcagtgcaaaagacaaaaaacaacatttgcttgatgtttggtttggacgtattgaagcagaaagtaaattttgtgtagaaacgactattgaagccgatgatgaatggctacattcgttttactactttaatgacgaaatcccaactgaagcggattttgaaaaagtcattgccgattacttgacctttgaagtcaatatgataacgcatggtagaggatatttgtttggattggggaaagatgatgagtgagttgaaactgacggatagaacgtggggaaaattttcgattggtgatttgtttcaaatagaaaattgtaaatgttccaaagtaagtgtattaaaagaaggaaatgtaccatatataggggctactaatagaaataatggtgttttatcttttgtggaaaataaatcctcttttattacaaaaggtaattgtattgtttttatttgtgatggcgaaggttcaataggttattctatatataaaaaggaagattttattggaacaacaacgataaaagtaggaagaaatgaatatttaaataaatatatagggcagtttattgttacttgttcaaatatgatgagaggaaaatataattttggttataagaggaatgaagccaatcttaaaagagaaattataatgctacctgaaaatactgacggagatcccgactggcaatttatggaagactttatcaagcaaaaagaagaaaaacagattgccgagttgaaaaattactatgcggataaagccttagagttgatgatctcaacaggtaatttgagaaatacaggatggagagagttttccttttctcaagtctttgctgaaattcaacgaggtaagcgtttaattaaaagtaatcaacaagacggaacaacaccttatgtttcatctacagccactaataatggtgtagataattttatcgacaactcaacaaatgttcgtatatttgaaaattgcctgactttagcaaatagtggcagtgtgggttctaccttttttcattattatacttttgtcgcaagtgaccacgttacagcattaagactggaaaagccaaataaatacatttacttgttcttgtcgggaattattaaacgcttagaagaaaaatattcgttcaatcgagaaattaacgataaacgaattcagcgtgaaaaaatcttattgcctgttaatgaagaaggattgcctgattggcaatttatggaaaactttatgaaacaaattgagcaagataaaattactgccgtacttaattattataaaaaaccttttaataacaataacttgcggggggggggggggggtagaaacatatctactacctaaaaatacgtggtcaacctttgctatacaggatatttgtgatatttattcaggagtgcgtttaacgaaacaagagatgataaatggtaatttgccatttattggtgctagtgattcaaataatggtattactgcttttattgctaatacaaatgccagtttggatcggaatattttaggagtaaattataacggaagtgtggtagaaaatttttatcacccttacgaatgcctattttcagacgatgtaaaacgtttaaaaattaaatcagaaagagtagggaaatatgcttatttatttttaaaaacggttattttgaaacaaaaatccaaatatcagtatggctacaaattcaatgcagagcggatgaaaaaacagaaaattctgttaccagttaatacagataatcaaccagattgggaaaatatcgaacgttatatgcaacaacttgaattggaaaaaatcgtatgttatttaaagagtaaacattattcctaataaatatatgaaaaggtcgtctgaaataaattttcagacgacttattttttgtatacttacgaatagactaaacaagatttcagttaaggagcttgtatgagcaaatcagaaattgtttcttcagtggcggaatatctcacctttatgaccgccacaggcgagagccaagtcaatgccatttatgcggacgaaaatgtctggctaagccaaaaaatgatggggcagctttatgatgttgaagtacctacgattaactatcatctaaaaaaagtatttgatgataatgagttagacgaaaattcagttattagaaattttcgaataactgccgatgacggtaaaaattaccagaccaaacactataatctttcggcgattattgccgtgggctataaagtcaattccgagcgagcggtgcaatttcgcaagtgggcgacagaaattatccaaacctacaccatcaaaggctttgcgatggacgatgagcggttaaaaaatgacggcacacgtttaggcaaaaagtattttgaagaacaacttgcccgtatccgagaaattcgcctgtcagaacgcaagttttaccaaaaaatcaccgatatttatgcgacttccattgattacgaccgcaccgccaccgcgaccaaacgcttttttgccacagtgcaaaacaagttacattgggcaattcacggtcatacctccgcagaattaattgtggaacgagcaaacgccagcaagccgaatatgggcttgaccacttggaaagacgcaccgcagggcaaaatttatccttttgatgtggtggtggcgaaaaattatttatctgacaatgagttagcccaactacaacggctagtgtccgcttatttggatatggcagaagatatggcgttacgccaaatcccgatgacaatgcaagattgggaaaccagactcaaccgctttttagacgctactgaccgagccgtgttacaagacgctggcaaagttaccgccgaaatcgccaaagcccacgccttgagcgagtttgaaaaatatcgtgttattcaagatcaacattttgaaagcgattttgaccgcttgttgaaaggggaagggtaaaagagtggtaggttttggggagatttggtatttttgctggcatattattcggaggtatcacttattggcttgttgggttattttcatctagcttagctatagctgctggaattgcaataggtgtgatattttggattgtgacaccatctgtaaacaaaatgcaataactaagttaatatgtaatgcttccaatatgggggcattacatctcagaccgctgacaaactatatattaaacagattgaatattgtagggtgggttttaacccaccaataaaatcaatatgttacggttatatggtgggtcaagacctaccctacaagctgattatctatttatttgcaaaatcttcatgagagaataccgcttatttaattaccaagtggtataaaacaaatagatatttctaaataccacttataatattacttcatctcagccaacgccaaatccgccatttcaagtgtataagcaatatcttcgtcactatgtgctaaagacataaaacctgcttcaaaggctgatggtgcaagatagacacctttttctaacattttatggaagaaggtattaaacgcctttacatcacatttcatcacatcttgatagctttcgattttggcttgttcggtaaagaatagaccaaacataccgccaacatactgaactgtcattggaataccgtgtttatccgctaaggctttgaaaccttccgcaagggttttggttttctctgcaagcagtcgctcattacctgcttttgatagctccgttaagcaagccaaaccagcggacattgcaattgggttgcccgaaagcgtacctgcttgataaaccagaccggttggggcaataaattccataatctcttttttaccgccaaatgctcccactggcataccgccaccgatgattttaccaagcgtggttaaatctggggttacgccgtagtaactttgagcaccaccaagtgcaacacggaagcctgtcatcacttcgtcaataataaataccgcaccatattgagtacagagttcacgcaagccttgcaagaagccttcttttggcggaatgcagttcatattaccagccacaggctcaatgattaaacaggcaatgtcgtttggatattgttcaaaggcttgtttaaccgatgctaaattattgtattcgcaagtgagtgtatgttttgcaaaatcttcaggtacccctggagagcttggctgacctaaggttaatgcccctgaacctgctttaactaatagtgaatctgagtgaccgtggtaacagccttcaaatttaataattttgtcacgtttcgtatagccacgagcaaggcggatagcagacattgtcgcttctgtgccagagctgaccatacgcaccatttcgattgacggtacgagtttgcaaactaattcagctaactcaatttcaatggctgtcggcgcaccaaaacttaatccgttgggtacggctttgagcactgcctcaataatggctgggtgattatgtccaagtaccattggaccccaagagccaacgtagtcaatgtaacgcttgccttcgctatccgtaatataagcacctttggcactgtcaataaacacgggtgttccaccgacacctttaaaagctcgcacaggcgagttcaccccacctgggataacacgttgtgctttttcaaaaagagattgagatgttgtcataagaatccttaacgtgaatgacgtaaaatggagttattttactgtaaattacgctttctgcgtgaaaaaaattgagtgtttcagcggttatgctatgctagccagcattttagttttcccttattgaaaggataaaccgagtatatgtggctgacatttattgctgtatttttggtttcttttatctcacttattgcaatgcgtcctgtggcggaaaaaattggtttagtcgataagcccaacttccgtaaacgccatcaaggtgtcattcccttaattggcggtatttccctttatcttggcaatctcgctttctatttattggaatgggaacagatgcgattgccagagctgtatttgatcgcattaactattttgttagtgattggcgtattagatgaccgttttgacttaagtcctttcttgcgagtgggcattcaagccgtacttgctgaagcaatgatttacagcggtttatccattgaaaacctaggacagctcatcgccccttttagcctagaaattggggtattaggtgtcgtgctgaccgtctttatcaccatcggtgttattaatgcgttcaatatgattgatggtattgatggtttgcttgcggggctttcttcggtaagttttgctggattaggcacattaatgttacttgacgagcaatatacgctagcctattggtgctttggtattatcttggtgttactgccttacgcaatgtttaatctcagcgtttttggggcaaaatggaaagtctttatgggcgattccggcagtaccctaattggttttaccatcatctggattttactactcagcacacaaggacaaggacactccatcagcccaattacaggtttatggctgattgccgtgccactaattgatatggtcgctgttttcttccgccgtttgaaaaaaggtaaaagtccatttagaccagaccgcttgcatattcaccatttgatgatgcgtgcaggtttaacctcacgccaagcgttagcggtaataacctttggtgcagggctttgtgcgaccttcggcgtaattggcgaagtttattactggaaccaatgggtaatgtttgttgcctttgtttcccttttctttctatattcttattctattgtccacgcgtggcgaattactcgatttgttcgtcgccacaaacgccgtgcaagaagaaaacagactgtttagaggctaaaaatgagcgagcaagttcaaacacaacgttctagtgtaggactattttttacatctttatttttattattaatactttctgctattggcggtgtagcgggttggtttggtgcaacaacgcaaacagcttattggaaagctgaggtacaatttgaagtccctaaggtaacagatttaggaaattattattcactgcataatacttataatttgttaaaaaacgatttagccacgaatgatcttgccattattaattctgcatacaaagagtttacaagaaatgtcaaatccccagatattttgcagcattttttagtgcaaaatgagattgtaaaacagttagcggcaaagcagaataaacctgtttcattagaggctcaacaacttgcttcatcttttcatttcaatgaagctacaaatacgctaagtacaacattaataaatcctaatgaagctgtaacattacttacagactttattgcttttagcacattacaaactcgagctgatttaaatactgaattaatcacaaaatggaaagttttattccaacaagtgaaacaacttgctgaaactagcacaggaacggcacaacaagaatggacaacaaaattaaatttaatgcgttcagtacaacctttagataatcaactaactgcatatcgtttagttaaatctccgacagtgccaaccaaacccgaagcccctaaagatcagctgttatgggcagccattggtggcggcattgggttactgctaggtttttttgttgtgttgtttattaatcgtaagaaaaactagcctgtggcatatcgtattttagcggtctttggtactcgaccagaggcaataaaaatggctcctcttgttaaaaggttacaacaagaaggggcttttactattcaagtttgtgtcactgggcaacaccgtcaactgctctatcctgttttatctttgtttgatattcaacctgactttgatttaaatatcatgaaatcaggacaagatcttgcaaatataacaagccgtattttgctaggagtaagtgaggtgttggctcaatctcagccagatcttattttagttcacggcgatacaactactacatttgctgccagcttggcatgctattaccagcgtgtaccgattgcccatatcgaggcaggactacgtacaggaaatcgtttttccccttaccctgaagaagctaatcgtcatttaaccagcgtgttagccaactatcattttgccccaacagataaggctaaagctaatttattggcagaacatcatgcagaagatcgtatttgggtgacaggaaatacggttattgacgctttaatgatgatgtcgcaaaaaattacacaaaaccgaccgctcacccaacagctacagcagcagtttccctttttagattcacataaaaagctgatcttagtcacaggacatcgccgagagaacttcggtgatggctttgaacggatttgtcatgcattacgaatattggcagaacagcatactgacatacagattgtctatcctgttcaccttaatcctaacgtaattgagcctacccaacgtttgttagcaaatattgataatctctttttacttgagcctcaaccttatttgccttttatctatttaatgcaacaagcctatctaattttaactgattctggcggcattcaagaagaagcacctgcattacataagccagtactgttaatgcgagaaatcaccgaacgtcctgaagctgtgttagctggcacagtaaagttagttggaactaatgctgagcatattgttcaaagtgtgaaggcattattaaatgatccacaacaataccaacaaatgagccatgctcaaaatccgtatggtgatggcaatgcgagtgaacgtattgtcgcggtgataaaacaacttgcacaaggaacaatgtaatggctgtatttgaacaaatagtggttgtagggttgggctatatcggtttacctacagcagcggcttttacacttgcagggctacaagtgattggcattgattgcaaccctcgtgtgatcgaacaaatcaatcaaggtcgaagtcatctacatgaacctgaactagctcaagctgtattacaagcggtaagttcagggcatttttatgcaagcacggaaccaacctttgccgatgcatttattattgcagttcccacccctctacaggcgaaccgtcaaccagatttaaccgcaatacaatcagcagtgaaaagtatcgcaccctacttaagacaagggaatttagtagtattagaatctacctctcccgtaggaacaactgaacaacttgctcaatggattgaaaaagaacgccctgatttatctattcccacagatgtggcggtcgcttattgtcctgagcgagtattgcctagcaatatttggcatgagctctatcataacgaccgtgtgattggcggattgaccccgaactgcacacaacaagcggtagcgttgtatcagctttttgcaaaaggagaatgtattactactgactctcggctggctgagatgtgtaaactcactgaaaacagttttcgagatgtgaatattgcttttgccaatgagctatcaatgatttgtgatcaactcaatgtcaatgtttgggagttgatccgcatagcgaaccgccaccctcgcgtaagtattttacaacctggagctggggttggagggcattgtattgctatcgatccatggtttattgttgctcaatcagaacatgcacgcttgattcgtactgcacgagaagtcaatgatagtaaagcgttttgggttattgataaaataaaaagttgcctagccgaatgtgccgttgcaacaaatcgtaaaatttctgatctgacattagcttgtttagggattacctttaaagctaacgtatccgatctgcgagagagcccagccctagcaattacagaatactttgccgattggcatcaaggtaaattatgggtggttgaaccacatatagctcaattgccagcttcccttgcagaaaaagtagaatgggtggattttgctcaaggtatcacagcggatgttgtcgtgttcttagtagatcatctggcatttcagcaacatgctaaaagacatctatctcctacatggttggtggatacaaggggagcgtggacaaattaatttggtttattactctgattaagtgaaagagcttgtatatataaagcaatcatctacaattcactttatcttgaagggataaaattatctatgtttaaaattatttttacactcttttccttgagtacattttatttgcctgctactgcaagcctatttagctcacaacctaaatttctacccagcgatcaggcatttgcgttttcatctcaacagcaagcggatcaactgcaactcgcttggcagattgccgatggctactatctttataaaaaagagatcgccatttcgtcaaacaatgccaaactgggcgagccacaatttccaacggcagagcgttaccaagatgagttttttggggaagtagaaatttatcgcaatcagctaacaatccccgttgcccttgaagcgaatgcgactgggcaagtggtggtgcgttatcaaggttgcaccaaaggcttttgctatccccctgaagaagtaacccttgatttacaagcggcgacttccgctcacaatgttgcaaaaaataccgcagatgttaccgctatttctgtcgctcaacctaaagccgaacagaaccaacttgccgaaaccttagccgaaaaccgccttgctattttttggttctttgtgctagggctggggcttgcctttacgccttgtgtgttaccgatgttgccactactgtctgcgattgtgatcggcagtaaacagcgtccgaataacctacgcgcgtttttgctcagtttaagctatgtgcaaggaatggctgtcacttacacgctcttagggctactggttgcggcgattggcttgccttttcaagtcgctttgcaaagtccgcctgtactgattgggctttcgttgctctttattttgctcgcaatgtcgatgtttggtctctttaccctacaacttccacaccgttggcaacaaaaattaaatcaactaagccaacagcaacagggcggatcgttttttagcgtatttgtaatgggaatgatcgcagggctagttgcttccccttgcacatcagcacccctatctggtgcattgctctatgtggcacaaagcggtgacttactgacaggcggtttagctctctacctattagccttaggaatgggcattccattgatgttagtgacccttttcggcaaccgcattttgccaaaatcgggggattggttgctgaaagtaaaaacgctgtttggcttcgtaatgttggctctgcctgtctttttgctctctcgtgtgctacccacttttattgagccactgctgtggtcggctctggcgatagcctttttactctggctaaatgagcagtgcaatggtttgcagggttggaaaaaagtgtttcgtttgcttgtgttggcaacgttggtcgttgtgagcaaaccttggctagatcttgcgtggcaacctacgccagtaaaccaaactcaaagcaaccattttaaacgcattcactcccttgcagaattagagcaacaactgaccgctaacaaaggtaaaaaagtgatgctcgacctgtatgccgactggtgcgtggcttgtaaagagtttgaaaaatatactttcgttgatccaaaggtgcaggcgaaattggcagaaatggcagtgttgcagatcgatatgacaaaaaactctggtgaaaatgatgaattgatgaagcattttcaagtgctgggcttgccgactatccttttctttgatgagcaaggcagggaattgagccaatctcgtgtgacaggttttatgcagtcaggtgactttgttcaatggttaaacggattaacacaatgaaaaccatcttaattacaggctgttcgtcgggcataggttatgcaacagcccattatctcaaacaacaaggctggcgagtaattgccagttgtcgcaaagccgaagatgtacaacgtctgcaatttgaaggctttgaatgtgttgaacttgatgtgactaactcagcccaaattgcccaagtctttgattatattcaacaaagcggtggtttagatgcagttttttgcaatgcaggttatggacagccagggacagtggaagacattccccgtgaagccttgcgtgaaatttttgaaaccaacgtatttggggcttgggaagtgatgaactacgctttaaagctatttcgccaacaaaatcacggacggattttaatcaatagtagcattttaggctttgccgcaatgcactttcgtggggcttacaacagcactaaatttgctttagaaggtatggcagacacccttcgccacgaattgcacggctcgaatatctatgtcagcctgatcgaaccaggccctattcaaagcaaattccgccctaattctgtggtgaaattacagcaatatattgatatagaaaattcattccacaaagaagcctatcagcaacagttggcacgcctaaacaccaaaggaaatgccaagccctttacgctaccagccattgaatgtgctaaagtttgtttagacgcactcaatgccaaacagcccaaagcacgctatcaagtgaccttcccaaccaaactattttggtggctaagacgcattctgcctacaaaagcctttgatttttgttgtaggaagggtgggggatgatagtagaaacttactatgattgatgctttttatgttagctttctcatcacaattgtaaccatatgaaaatgatacttttggattgatgtattaaataaatcctttaatagccctctacatccaccatttgtaatggattgaattctatggcttttttcacgaagtatgttcaatgcgagtttgtaaaggacagttttttgttcatatttcaaaaaagtgggcttaaagccttgtactataaggctttaagccatttttaccaacacttttgtctactatgccgataattatttcccaatacaaaaggaactgaaaatattaccgagtaaatcgtctgaggtaaattgtcctgtgatttcgcttaaggcattttgtaccattcgaagttcttctgccaataattcacctgcatagaactgggttaattgaatgtgtccacgttctaaatgttctgcagctgtttcaagtgcaactaaatggcggcgacgagcaataaagccaccttcggtagaactttgataacccattgatttttttagatgttctcgtaataaatccacaccaactttagtttgtgctgacaggcgaatcacagtgaaattatctgcttgaaccaaactttctgcttctcctgttaaatccactttattacgaataacagtcacgggaatgtttttcggcaacttcgctaaaaatgtcgcccattcttgttggaaactatccgcttgagattcattgctatcaatcattaataaaacgtggtcagcctgttcaatctcgtcccacgcacgtttaatcccgatcttttctacttcatcactggcttcacgcaaccctgcggtatcaataatatgcaacggcattccatcaatatgaatatgttcacgcaacacatcacgggttgtcccagcaatatcggtaacaattgccgcttcatgaccagctaacgcattgagtaagctagatttgcccgcattaggtttacctgcaattacaactttcataccttctcgcaaaattgtaccttgcttagcctcctgacgaacattagcaagttgagcgatgatctcattcagttttgcttcaattttaccatcaactaaaaaatcgatctcttcatcagggaaatcaatcgccgcttctacataggttctcaaatagataacagaatcaaccaattcattgattttattggaaaattcaccttgtaatgattttagagcggaacgagccgcttgttcagaggttgcatcaattaaatctgcaatggcttctgcctgtgcaagatcgagtttattgtttaaaaaggcttgctcagaaaattcgcctgctcgagcaatacgaacccctttcacttttaaaatgcggttgagtaagaggtctaaaatcacttgtccgccgtgtccttgtagctcaaggacatcttccccagtaaacgaatgaggggctttgaaaaagagggcaataccctgatctaacacggtcccatcttcatctttaaaaggaagataatcagcaatacgaggcttagggcatttacctaagaccgcttgtgcaacctctgtagcgagaggccccgatactcgcaaaattccaattccaccacgtccaattggagtggcttgtgcagcaatggtttctttcattctaaataagttgagtataatgagaatagtgtattgtaccccataaaagcggtgagattgagataaaattttactagagttgagattagacgaaaggagaaagccatttttagtgtagatatctactcatgtaaattcttgtgatctagttcacatttataacttattgatattgagaggattatctataatttattatggtatagcttctttcatttatcaggaggttatatgttaaatctaactcgttgttctcttctattagggttaggtggagctgcagctctagctatcacaccatctattgcgaattcagcagggtttaaagtacgttctgctgtgtttgaaattcgcccccctaaacgtcacttaaaacactattttgcctttgatacaggaatttatcatggtttaaaaatgcataatatgaatagatgaaaaaggggtttatcattgttattacaccttgtttgttgtggatccctcttcacgttctacacctcgagaaaagcgtcattctgctcaatatagcactaaagatcgtcaagtagggctagcttatgcacgttctaatgatggtatcctgtgggaaaaacctaagttgggcatcgtggattttgaagggagtaaagagaacaatattattatgcgagatgtggcaggaacaggtattttatatgaaccaacggaagttgatccaaataaacgttttaaattaattactcgtacagggcaaccgcatatgttgtccatttttcaacctacacgccgagcaatagctcatctcgaaattcatctgaccaaccggcagcggtcaatttccctttcatactctgctttttcgggtgtaatcgtgccaagttcaacgctaatcgacgcaagattgccagattttccgcaccccattcatcggtcacagcacattcgtcttctttatagaccacatctagcacccaatgggctttgttttccacttcccaatgccctcgcacgcacttcgccaacatttgaatatcagcatccaaactacggatataaaaaactttttcttgcgattctttgccattatctgaccgcttgcgacacacctccaacaccgattttatccccttccattcctccgctttgctcagccaatcactcactttcagcttacggtagtaacgctcatcaattcgacgacgttccgcatttacctcctcaaaagtctcaagcatttcggggcaatctcggctgattttgtgaaaatacgcctccacttccgactgaaattgacggtaatttttcttcaacggcatcacataatctcctttcttttcgatgattttctccgcaattttcttctgtgtattcatcgcatccaccgttataacggcattttttaagcaaaaactgtcgataatttccatcaccgcctgctgctcattttgcttacccgaggattttttctgcgacaaaatcaaaccacgagactggctccacaccgtcacactgtgcaaagcactttgggtttccggattgaaactatgacgaagtgtcttgccatcaatcgcaatcacttcacgtccttgttgtgtgcgtatctcattgataaaattaagaaaaacctcattaaacgcttgtggctcaatgcgttttattacacgagcgatagtatcatcgacaggaatgccacactcaaaaggacgatattttcgcaaccaatccaaatgtaattcgccaaaaagtttgatttcagtccagctgtttgcccccgaaatcacggcactgacgacgagaaaaacgatgtctaaaaagtggtgtttttgattataggctcgtaggtcggataaattttcaaaaaaacgaaaaacgctcattttacaacctgatttgatatggataattaaggtatattagatcataaatttgagaaagatgcgatcttgccctggtcgcttgtaagtgagttgatgtaaataggttgttcattacagcaaaaaagccgataatacacgacattttttagattttctgatgataaattcgtgggttaaatggttgagtatattctgttaattatcagtacggcgttaatcaataacttcgtgcttgtgaaattcttggggctttgtccgtttatgggcgtgtcgaaaaaggttgaaacggctatcggtatgagtatggcgacaaccttcgttttgacggtcgcttcgctttctgcttatttggtcgaaacctatctgctcgttccccttgaagctcagtttttacgcaccttggtctttattttggtgattgcggtgattgtgcaattaactgaaatgatcgtacacaaaaccagccctgctctttatcgtttactgggtatctatttgccactgattactactaactgtgcggtattaggggtggcgttgttgaacgtgaatttatctaataatcttgtgcagtctgtgctttacggcttcggtgcggcggcagggttttcattagttttagtgcttttttcagctttgcgtgagcggttagtcgcggcagatgtgcctagagcctttcaaggtgcgtccattgcgttaattaccgtagggttgatgtcattagcctttatgggctttacaggtttggtaaaaatctaatgttcgatcattccattattctctatattttaattgcaattgctgtgattgccttgatttttggggcgatgttgggctattcgtcggttaagctgaaagttgaagccgatccgattgttgagcagatcgatgctttgctaccacaaagtcaatgcgggcaatgtggctaccctggttgtaagccctatgcggaagcggtagcaaatggcgacgacattacgaaatgtatcccaggtgggcaagcgacggtggtgaaaatcgccgagttgcttggggttgatgtgcctgaaacatcgggggaagagcctgtggcgaaggtggcgtatattcacgaagagttgtgtatcggttgtaccaaatgtattgcagcttgccctgttgatgcaattatcgggacaaacaaagcgatgcacacggtgattgccgatttttgtacagggtgtgaactctgtgttgccccttgcccgactgattgtattgaaatgataaaagtgaaacaaacgacacaaaactggaactggaaatttgatgcgaatttggtgatcccgattgtgaataccactgaagttgaaaagaaaattgtggttgggggaagtaatgcaagctgatgtattaagccgtattcgtgaaggaaagttatgggatttccctggcggtatccacccgcctgaaatgaaaaaacagtcgaaccaaaagccgatccgttcgttacatctgccaaaatttttctatgtgcctgtgttgcaacattcgggaacagctggggaagtgattgttcagcaaggggatttggtgctgaaagggcaagccctaacgaaagggggtaactatcgccaactgcctgttcacagtccgacttcgggaaaagtggtcgctattcagccccacgtttcgtcacacccatcgggcttacccgaattaaccattgtgattgaaacggacggcgaagataagtggatcgaacgtcagccgattgatgattttttaagcttaacaagcgatcaaattattcaaaaagtttaccaagcagggatcgcaggcttaggcggtgcggtcttcccaacatcacacaaattacatgttgccgataaacgctgtaagttgttgattattaacggtgcagaatgcgaaccttatatcacttgtgatgatcgtttaatgcaagattatgccgatgagatgatcgaaggtgtgcggattttacgctatgtgcttcgccctgaagacgtggtgattgctattgaagataataaaccgaaagcgatacaagcggtcgaaaaggcattaaaaggtgcaaatgatattagcgtgcgagtgatcccgactaaatatccgtcgggggcaagcgatcagttggtgcaagtactgacagggctggaaattccgcaaggtaaacgaaccattgagatgggtattatgatgcacaatgtcgggacggcatttgcagtaaaacgtgcggtaatggacgatgagccgttaattgagcgagtggtgacgctgacgggcgataaaatccgcaataaaggcaacgtttgggcaaggctcggcacaccgattttgcatttgcttgaacaagtggattatcaagcggatgaacgttttcctgtctttttaggtggaccgatgatgggctttattttgccgtcactacaatcaccgattaccaaaacagcaaactgtattatagcccctgatcactttgaatatgcaccgccagaaccagagcgaaattgtattcgctgttcaagctgttctgatgcttgtcctgtgggattgttaccgcaacaactttactggtttgcccgtgcagaagatcacgataaatcaaaggaataccatttagatgcttgtatagagtgcggtgtttgtgcttacgtttgccctagttacattccgcttattcagtatttccgccaagaaaaagccaagatccaagaagtcgatcaaaaagccaaacaagcggaagaagcgaagatccgttttgaagctcgtgaagctcgtttaaataaagagaaagaagctcgcacggcgcgtattcaacaagctgctgaaaaacgtcgtgaagaagtggcaaatagtcaaggggaagatccagttaaagcggcacttgaacgcttaaaagcgaaaaaagcagaaacggctaccccagttcaaaccaaagccaacggtgagccagataacagcgaattgatggcacaacgtaaggcaagacggttggcgaagcaggtggaagttagccctctccctgattctcgcgacattacgtcgcttgaatctgtccctctcccgcaagcgggcgaggggaatgatccacgcaaagcggcagttgcggcagctttagccagagcaaaagcgaagaaagaagcacaacaagcggcggtttctgatgaaaatgttgcaaaagctgaagttgcggaagacccaagaaaagcggcagttgcagcagcgattgcaagagcgaaagcgaagaaagaagtacaacaagtggcggtttccgatgaaaatgtggtaaaaactgaagttgcggaagatccaagaaaagcagcagttgcagcagcgattgcaagggcgaaggcgaaaaaagaagctcagaaatagcatagtagggacacactgcgtgtgtccgcattagttaaacccccacaacgttgatttacggacacacgcagtgtgtccctacatatattattgttatgaaagtgacacaagtaaatgaactaataattaaggaacacaaatgaacgaattatttcccccatttccgtggtcgtttttgtttattcaagacttgattggtactattgtttttgcgatttcaggggcgattgcggcacgccagcacaaaatggatattttcggtatgtttgtattagcttttgtgacaggcgtgggcggtggaaccttgcgagatgtgatgattagcagtacccctgtgttttggatgaaacagccgatttatgtgctgatgatttcagtggcggtagtgattgtggcaattttgaaaaatcagatcgaccgtgattattggaaaaaaggcttgttgatttttgatgcgattgggttgggggtgtttactgtaattggtgtgcaaaaagggctggattttggcttgcatccgttaatttgtgttgcattaggcggtgtaacaggctgttttggtgggcttattcgggatattttacgcaacgaagtgccggtcattttacaaaaagaagtgtatgtgaccgcaagtcttgttggcggtattatttttattttgttccgtgatgctgggtttgaaagtaattggattgatgtggcaacggtaacgacggtcattgcaatccgaatgctcacgattaaatttaatatgcatttgccgaagatttagcaaatttagacgatataaaggaaacatttgatgtttaaaatgatcagttccccccacacgcattccaacaacttgacagcaaattttatgctgtgggtggttggtgctatgttgcctgcattagtggtgcagtggtatttttttggttacggggtattcattcaggcgagcttggcgattggcttggctgtggtgattgaaattgccgttgcaaaattgcgtggtaaagcgaccgctttctatttggcggatttatcggggattttgaccgcattgattttggcgatggctattccgccctatgcaccttattgggtaattgtgattggcgtgattgtggcgttgttgctggcaaagcacgtttatggcggtttggggcagaatttatttaaccctgcaatgattggctatgcgttgttgttggtgtcattccctgtgcaaatgacggcgtggttgcctcctttggcgttattaaatgagccaccgacgttagcggatagtttttcgctgatttttgcaaatgtcaccacggacggctttaacgttcatcaacttattcaaagtgtcgatggcgtgtcgtctgccacagtgttagacggctcaaaacaggctatgagtagcattaaagataatgtgaccttaggtattcagttagacaaactttttgcagatgtgttgctcggcggttgggggcaagtgaatttagcctttttgcttggtggtttgttattgatttataagcgaattattcattggcaaattcctgttgcgatgttgggggcttttgccttgttgagctttgcgacagattttgtgtcagaaacggctcgttggacggctcaagcccagttatttagtggggcgatgatgttcggggcattctttattgcaaccgatcctgtcaccgcttcaatcacgccaaaaggcaaactgattttcggggcgttggtcggtttgttgatttatttcattcgttattatggcaactaccctgacggcgtggcgtttgcggtgttgttggcaaacatctgtgtgccgttaatcgaccactatactcagcctcgtttatacggcacaaaattaggacggaaacaatgaaaacatcagtgattaccacacgttacgccctgattttaggggcgatagccttactatgtacggcggtttcgacgggcgtttatctgctgactaaaagtcgaattgatgcggttacggcagaacagcaacggcaattattattagaagttgtgccacaagtacattttgataatgatctattagcaacttgcaaagtggttaaacttcctgaagcgccgtttttaaataaaatctatatggcaaaaaaaggctcggatctgaccgcttacgccattcaagccaccgctccagacggctattcgggcaatatagagctgttgatgggtattcagcctgacggcacggtattaggtgtacgaacccttgctcataaagaaacgccggggctaggcgataagattgaaacgcgtattagcgattggatttacagcttcaccaaccgcaaatttagcttagagaatgaaggcgaatgggcggtaaaaaaagacggtggtaccttcgatcaatttactggtgcgaccattacaccaagagcggtggtgaataatgttcgccaaagtgcaaaatgggtgattactcagttaaagcaaaagcctgaaatggtggaaggttttttgagttgtaaataatgaaaaatttagagataaaatatgcaagaaacccaaatccctattactcaaattgaagaaacgacagccgaagcaaaatcttcagtttggaaaaatttatttacgcaaggtgtatggacaaataactcgactttagttcagctacttggattgtgtccgttgttggcggtgtcgaataatatcacaaatgccttgggcttaggattggcaaccttattggttttgaccattacaaatacgatcatttccttgttccgtaaggttattccgcacgatatccgtattccgatttatgtgatgattattgcaactgcggtgacgactattcagttgttaatgaatgcctttgcttttcctgtgtatcaatctttgggtattttcgtgccgttgattgtgacaaactgtattgtcatcggtcgggcggaagcctttgcctccaaaaatagtatcgcccattcagcttttgatggctttgcgatggggttggggatgacgttaagccttgtggtgcttggggcgatacgagaaattattggtaacggtacactgtttgacggcttggatttattgctaggcagttgggcaaaagccttaagaatggatctgctacatttagattcaggcttgctattagccattttaccacctggggcatttattggtttgggattgattttggcggtgaaaaatattatcgaccgtaagaaatagggcaaaagaatgtcagaacgtgaaacatatcgagtaggttatcaacatcagtttcaaaaagcctttttacacccgaaatattggggaatttggctaggaatgttgggactagtgatcttggcttatgtgccatttcgttggcgtgataagctggcgacctgggtaggaaaaatcgttgctaaaaagctgaaagggaaaaagcaatatcatcgagcggatagcaatttacgctactgttttcctgattggccggaagagaagcggtcagatgtgattgaaaaaatgtttattactgtcgctcaaacgatgttaggaattggtgaaattgcgttgcgttctgttgaacatattcaaaaacgtagtgagttttcaggtttggatattgtacgagaagcgagagcgaacggtaaaaacgtgattttactcgtgccacatacttggtcgattgatgcgtcggggattattatgcatacctacggaatgccaatggtttcaatgtataacccacatcataatccccttgtcgattggctttggaatcgcactcgcgaacgttttggcggcaaaatgcatacccgtcaaaatgggattaaaccctttttaaatgatgtgcgtaaagggtgtttgggttattttttgcccgatgaagacttcggtgaagccttgagtgtgtatgtgccattttttgcgactgaaaaagcaacattgccagggctagcgaaaatggctcgtgtggcaagtgcagtggtgatcccaatgttcccgatttacaatgcggaaaaaggcgtgtatcaaattgaaattttgccaccgcttgaatttgcaggtgatgagcaacagtcggcacggcaaatgaacgaagtgattgagtactttgtgccaaaaaatccagagcaatatgtctggatcttgcgtatcttgaaaactcgccgtgatggtgaagatatttacaagcggtaggatttgagagatttttgcaaatgaaaaccagcatctacgacaacccgattttctttgaacgctatcttaaactgcgtgaaaatccgataagcctaaatgaagtggtggaaaagcctacgatgttttcgcttttacctgatctgaacggaaaaaaagtgctggatttaggttgcggggctggtggccatttgttgcattatatggcaatgggggcgaaacaggttgtaggcttagatttatctcaatctatgcttgaacaagctgaaaaagattttgcaaaaaatagcgtagatccggccgcttaccgtttttattgcttaccgatggaagccttatccaccatagcagaaagctattttgatctggtgacaagctcttttgcttttcattatataaaagatttatcttccttattaacgcagatttctgccaaattaaaaccacaagggcaactgattttttcgcaagaacacccgattgtaacttgttttaaagaaggtgagcgttgggaaaaaatcaataggcaacaagtcgcataccgcttaaattattaccgtgatgaaggtgagcgtgatcgtaattggtttcagcaatcttttaaaacttaccaccgcactaccgccaccattttaaatacccttattcaaagcaatttcaccattgagcaagtggaagagcctatgcttgccgatcaagttgaatggcacaacgaatttaaagatcttcaacatcgccccccattactgttcataaaatcagtgaaaaaataaggctttttctatccacaaagcctgtggataactttgtggattacttttttaaaacacgccaaacccttgataattcatagggtttttcctccctctttacgattgcttataaaatagcttttgtttaaaaatcaataggttatattttggctagaggttaaatgtaaaaaaaattagattttttcacctttttttacttgacatcatttgcctgtgcaaaacttatcaaatatctatctatttatttattccactgaaataatttgtaaatctacctagatcattcagtagctaaggtttagaatgcctttagttttaatatttattcatttcggagcaaacaatggaaacgatcgttatcgttggcggcggtgcaggtggattagagcttgcaacttatttaggtaacaaattaggtaaaaagaaaaaggcaaatattattttggtggataaaaatattagccatttatggaaaccgttacttcatgaagttgcaacaggctctttagatgatggtactgatgctttaagttatcgtgctcatgcgaaaaatcatcactttgaatttcgtcaaggcacattaactcaagttaaaccagcagaaaaaatcattgtattagccccaatctatgatgaggcgggggaattattagtagcggaacgtaccattgtctatgataaattggttcttgcaatcggaagtcgctcaaatgattttaatacgcctggtgttgcagaacactgtattttcttagacagttcagagcaagcaaaagtattccataaacgtatgatggaattgtttttgaaattttcaaataataatgaaaaagaagttcatatcgctgttgttggtggcggggctacaggtattgaactatccgcagaactgtataatgcggttaaacatttaaattcttatggatatggtaagttagataatactagcttgaaggtgacattattagaagcaggagaacgcttgttgcctgcgttaccagaaagggtatcggcatctgcaattaaagagttacgtgcattgggtgtagatgtgttaaccaatactcctgttattcgtgcaactgcggagggattagttactaaatatgatgaaaactttaaagcagatctgatggtttgggcggcaggtgttaaagcccctgaaataacaaaaacatttggctttgaaactaatcgtattaatcaaattgcaatcaaagatactttacagacattaactgatgagaacgtctatgtgattggtgactgtgcctttttgctacaagcagatggtaagcctgttcctcctagagcccaatcggcacatcaaatggcagcggtttgtggtaaaaatatcttagcacaattagaaaacaaacctttaaaggcttttatatttgatgataaaggctcgctaatttctttctctcgttttggtacagtaggtagtctaatggggaatttaactaaaggctcaatgtttattgaagggaagatcgcccgtatggcatacctttctctttatcgtatgcaccaagtggctctacacggttgtgtcaaaacagggttgattatgttggttggtagaattaatcgttttttaagaccaacgatgaagttgcattaaccctcaacaaatttgaagtagtttatgtagagctaaaggattaacatggcaagaatagacaactacgaacaacgttttggcggaattggtcgtctttatacagctgaaggattagccaaattacgtcaatcgcacatttgtgtgattgggattggcggtgtcggatcttgggcggtggaagcgttggctcgttcaggtattggtaaattaaccttaattgatatggacgatatttgtgtcaccaacattaatcgccaaatccacgcaatgtcgggcgagatcggtaaattgaaaacggaagtgatgcaagagcggatcgctaaaatcaatcctgaatgtgaagtgacgatcattgatgattttcttacactggataatttaactgattatttgttaagagattatgattatgtgattgatgcgattgatagcgttagggtgaaagcagcgttaattgcattttgtaagcgtaataaaatcaagataatcaccacaggcggtgcaggtgggcaaactgatccaacgcaaattcagatcacggatttaagtaaaactattcaagatcctctagcgtctaaggtgcgtagcctattgcgaaaagagtataatttcagccaaaaccctaaacgtaaatttggtattgattgtgtattctctactcagccattgattttccctaaaatgagagagggctgtgaagtgtctgcaacaatgaattgtgccaatggttttggtgcagcgactatggttactgccacttttggcttttttgccgtttctcgagtaattgaaaaattattaagagaagcgaccgcttaaaatttgatattttatttaaagcaaacgtttgcattaagaagagaaacaagataaaatgtagtcctagtgccaagaaaggaactagaaatgcaaccaaatcatataacagtatccaacacactttttcagctgagcttcgctattcaacgaagcttggctgtttttttatcgcattatttttccatttctagaagatctcatttttgagatttttttttgcccatattttagaggataagcaatgagccagttaattcgtactttaaaaagccatattcgtgatgaagtgattaaaaaagggggctgggttaattcccacgcgcacgcagatagagcattcactatgacacctgagaaaatcaaaatttatcaaaatgccaatttacaacagaaatgggatttagttgatgaagtcaaacgaaattcaagcgtagaagattattaccgccgttttagccaagcgattgagttgatgatttcacaaggggtaactgcatttgggactttcgttgatattgaccaagtttgcgaagaccgtgcgattttggcagcacataaagcacgcgaagtgtataaaaacgatattattctacgttttgcaaatcaaactttaaaaggtgtaatcgaacctaatgctcgcaagtggtttgatattggttcagaaatggtggatatgattggcggcttaccctatcgtgatgaattggactatggaaaaggtttagaagcgatggatattttgatggataccgcaaaatcacaaggtaaaatgcttcacgttcacgtcgatcaatttaacaatccaaaagagaaagaaacagagcaattgtgtgataaagcggtggaacacggaatgcaagggcgtgtggtggctattcacgggatttcaatcggtgctcatcctagagagtatcgtcagatgctttataagaaaatgaaagccgttgatatgatgatgattgcttgtccgatggcgtggattgatagccctcgtaaagatgaagttttaccattccataatgctttaacgcctgctgatgagatgatcccagagggaattactgtggcaattggtacagataatatctgtgactatatggttcctctttgtgagggggatatgtggcaagaacttagcctactttccgcaggttgccgttttaccaatctcgaagaaatggcaaatattgcaagcgtgaatggacggaaggtgttggggttgatataacttccgttctaaatagtcatactctaaaagtatttaatgcccactcaacaccttcgcaggttctaatttagaagctctaatcgcaggataaaggcttgcgattaggcttaaaattagggtggcgagaagtacccaaacaatgtctagccaatgaatttcgctcggtaaaaagtcaataaaatagaccccgtctgagagcaatttcattccgattaaaccttcaaaccatttaataattgcagttaaattcattgacacaatcacgcctaacaccacgccgaataacgcccctttcatacctgaaatcaaaccgtaccaaaggaaaatatgttgaataaagcggttgtttgcccctaaggttcgctgaatggcaatatcaccctgtttgtctttgaccgccattactaaagttgaaatgatattaaagcacgccacgccaatcacaagcaccatcgcaatgtacatcactgtgcggatcagttgaatatcgttgtacatatatccaaatttatcaatccacgtttgcatatatagttgctgtgggtaattcgctaattcagggaatgtaatctctctggcttgaaacggctgtttcaccgctaattcaatgcctgtatattggcttgatttcagttctaacagttcttgggcttttgcaatcggaagcagtgcgtaactgtgatcaagttgtccgtctaaacgcaaaatacccgtcaccgttaagctaaaacgcaaaggttgggccaatttgccgtcgtcggttggctgtggcaataacagagtgacttcatcgccaacgttgatgtccagagaacgagcaattccagcccctaaaactaaaccgccctcttgcttgaacgcttgccattgatcttgaggaataaattgggtgagctggctcacttgttcttgtttggttggatctattccccgaacctgtgcaatctttagctggctaccattttcaatcaagccagtaaagctgacaaacggcgataaagcggtcacatttgggttatcttttacgatatgctcaaggcgatcaccttgtgcaatggtcgctgatttactttcgttatacgccataatttcagcgtgaggaacaacggaaagcactcgttgatttagctctcgttcaaagccgttcatcgcacttaagccgataatcagcaccgcaacgcccaacgcaatgccgacactagaaaagagcgaaatcaatgacaccaagcgatttttctgtttgtcacgctgataacgccaactgataaaaaatggggtactcattagttatcctcacgcaatacgccgtcttgcataattaaacggcggtttagtttgtgggctaaattcaagtcgtgggtcactaacaggaaagcaatctgctgttcttgatttaaacgctgaattagctcaaaaatactctcggttgttttttggtcgagattaccggtcggttcatcagcaaggactaacgcagggttattcaccaacgcacgagcaatcgcgacacgctggcgttcaccgcccgataacgccgaaggtcgatgggtaattcggtgagccaatcctaccgcttgtaacatcttttcggcacgatctttggcttccgttttgttttgttgtccgattaatattggcatcatcacattttccaacgcagaaaaatccgccattaagtgatgaaattgatagacaaagcctagatgttgattgcgtagttttgcaagggcattgctactgagcttttgcaatgattgccctttgataaacacctcgccgtcactaggttgatctaaaccgccaagagtgtgtaacaaggtacttttgcctgagccagagctaccaacaatcgccacaagttcgcctgcattcattgaaaaggatacgtttttaagcacctgagtagcattttcgccctcttggtaaaatttgctgatattttcacagcgaagaagttcatttgatgacattatgttttacttgttgaaagaaattattgtgtttcatcttaaacaaaaaacgtggtagatgctacatgaaagcagtaaaattcaatcatacttatgtgatcagattagacttgtaggagcttccccgctattttgctatagcatattggatttattggagggataaaacttactatataatgttctatccatttatggggatctctctgctcgttgagtttaattattgattaaatttgacggatatgagtactcataataagatgaaaacctttttattcattaatctttgaataagaattgttctttcccaatttaaaatttggggtttgtttttttatactaaatgggaatttatgaaaaaaattgaacgtctgtttgcaaataatcatgcttgggcaactcaaatgaaagatgagcattcagattattttaaacagctagcagaacatcagaaacctagttttttatggattggatgttcagatagtcgagttcctgctgagaagttgacgggattagagccaggagaactattcgttcatagaaatgtggggaatcttgtcattcacaccgatttaaattgtctttcagttgtacaatatgctgtggatgtgctggatatcgaacatattattatttgtgggcataccaactgtggcggtattaaggctgcaattggaatggaagatcatggtttaattagcaattggctactgcatattcgagatctatggtttaaacatagccatcttcttggaaaaatatctcccgaacataggggggatatgttagttcgtttgaatgtagcggaacaggtttataatttgggacgttcaactattgttaaatcagcttgggagagagggaaaaaactctctattcatggttgggtctatgatgttaatgatgggttcttaaatgatcaaggtgttatggcgacaagtcgagagagcttagagatcacttatcgtaatgcaatcgcaaaattattgagagagggtgacaataactcatagtcaatttttatccttcaatattttttacctatggtatttagggaggggaattatgaaaacagcattggtaacaggagtaacttctggattcggtttagctatttgtcgaacgttgattcaggcaggttatagagttattggtacagggagacgtattgaacggttaaagatgttaaaagatgaattcccagatcatttttttccgcttgcttttgatattcgtaatgcagatgaaacgattcatgctctaaataatcgaccagattgttggaaacatgtcgatttattagtgaataatgctggtttggcattaggcttagatgctgcatatgaagcagatttagatgattggtaccaaatgattgataccaatatcaaaggggtggttactatcacccatttgattttaccaggaatggtagaaagaaatactgggcatattattaatttgggatcaatagctggcacatatgcttatccaggaggtaacgtttatggggggacgaaggcttttttgaaacaatttagtttaaatttaagagcggatctaattgggacagcaatacgtgtgagtaaggtcgaaccggggttatgtggtgatactgagttttcgtacgtccgctttaaaggtgataaggaaaaggtatctaaactttatgaaaatgtagagtatttaaaacccgaagatattgcagaaatagtattgtggctgaatcaacaacctaatcatgtgaatgtaaatagcattgaaatcatgcctgtatcacaaagtttttcatcactcatggtacataaatcctagttcaattatagagagttgaaaaatgataacagaaaatatcaagagttctttggcttacaaatgcttttcgtggcgtttgaggctttagttctaatctattctgagtttgcttggaggctgttccgagcaacttattcaacgcgatgtctatcgaacgaaagaagattggggaaatatagattatctttgtgaaactgcttttcttgctggttggaatattcatcaacttgccgttgaagatattggttacgatgatgagaaccaacaattcgttgatcttcacggaaataatatcgatctcatttttaaactttatccactagaatggctaactaaaacagactttgctacttatattcctacggcaaaaacacagtttattgagctgatgtggaaaaaataccctaatcatccacttttgttaccaacctatctttcaaagcatcaaatatctcattcgacagatctttggattaaaaaaacaattttaggaagagaagaggctaatattttctatcattctgaacatcaaggtattgaatttccagcaaaaggaagtgagccctcttctttttatggttaaatggctatttatttcaataaaaaatatgcaataccttgctttgatggaatgtatccaattataggagcttggattgttggggatacagcttgtggtataggtattcgagaagattttaccgcaattacagggaatgataaccactttgtaccacattattttgtagaataatgcttaaataagcaaacgattacgtattttacattctatcccttgagtaatcctaagattttggctacactctgaacgaaatagccaagacttcctatcttcttgtgcatttagcactatcggttgccttcgtcaatttcatttccatcttatttcctgaaattctttattttattaagaggcactatgcttgaacgtttgtttcaattgaaagaaaaaggcagtaatgtcaaaactgaaattgtggcagggattaccacattcttcacgatggtttatatcgttttcgtcaacccatctattttaggtgtggctggtatggatacccaagttgtctttgttaccacctgcttaatcgcagcattcggaactattgcaatggggttgttcagtaaccttcctatcgcactcgcccctgcaatgggattgaatgcattctttgcttttgttgtcgtacaaaaacttggttatagctggcaaacaggaatgggagcaatcttctggggttctgtcggtttatttatcctcacgatattgcaagttcgctactggtttatgtcagccattccacttggtttacgcgtgggtattggtgcaggtatcggcttatttattgcgttaatcggctttaaaaatatggggctcgttgtcgcaaaccctgcgaccttagtggctttaggtgaattgcacgatccaaaagtcttaatgggcattttaggcttctttattatcgtggtactggctgcaaaaggcattcattcaggtgtgttaatttcaatcgttgtggtgactgcattagcgttaatctttgatcctgatgtcaaattctcaggtgtgatttcaactccaccaagccttgaagctgtcgttggacaagttgatgtcgcaggggcattagataccgcactgctaggaattatcttttcctttatgttggttaatttatttgactcatcaggtacattaattgcagttacgaacaaagctggaattgcagatgaacaaggtcgtttcccaaaaatgaaacaagcactttatgtcgatagtgtgagtgctatggcaggctcttatatgggaacatcagcaatcagtacctatattgaaagtggctcaggggtttctgttggcgggcgtacaggtttaaccgctgttgttgtgggtgtgcttttcctattaacgatcttcttctcaccgcttgcagccgttgttcctgcttatgcaacagcgggggctttagtgtttgttggcattttaatggcttcaagtttaattgaagttaaatgggacgacttaaccgaagcgacacctgcatttattactactgcaatgatgccatttacctattcgattaccgaagggattgcttttggtttcattagttattgcattatgaaactctgtacaggtcgagtaaaagagattaaccctgctgttgcggtagtttcactgctctttattgccaaatttgtttgggttggataatttcgtcttgtgagcacacgttatgtgctcacattacctctatgcgatatcatttccagtctttacaaaatttgcctgtctaattaatttttttgacaaaaaaatctgcaaacgtttgcgtttttctatataatgttcgcctgagctatgtctttgtagcttggcgactatcaaacattatagagagttgaaaaatgacaacagaaaatatcagcacgcctaaacaagcgtttgttggcttacaaatgcttttcgtggcgtttggggctttggttctaatgccattgattacaggcttagatcctaatacagcacttcttactgccggtatcggtactttaattttccaaatctgcactaaaggacaagttcctattttccttgcttcttcttttgcttttattgcacctattcaatatggcgttcagcaatgggggatccctgttacaatgggcggtttggtctttactgggttaatttattttgcgttatctgcattagttaaatttaaaggtgtggcaattttagataaattatttccacctgttgtagttggtccagtaatcatcattatcggtttaggcttagcacccgtcggtgtagatatggctatcggtaaaggcactgatattccttatgcaacggcagtgactgtttcaatgattaccctaattaccacactaattgtggctgtatttaccaaaggtatgatgaaacttgtgccgattatgttcgcaattgtggtcggctatattgtgtcactcttcttcggtttagtgaatttccaacctgtttatgatgcggcgtggttcagcttgccaaaattaacaacacctgaatttaaacttgaagcaatcctctacttacttccaatcgcacttgcaccagcagtagaacacgttggtggtattatggcgattagctctgttacagggaaaaacttcctaagcaaaccaggtttacaccgtacacttttaggtgatggcgtggcaacatctgctgctgcaatgctaggcggtccaccaaatacaacctatgcggaagtaactggggcggtaatgctcaccaaaaacttcaatccaaaagtgatgacttgggctgcgtgttgggctattgcaatctctttctgcggaaaagtcggtgcattgttacaaactattcctggtgtcgtgatgggcggtattatgatgttagtgttcggctctattgctgcagtaggtatgagtaccttaattcgcgctaaagtagatatgagcgaagcacgcaatctctgtattgtgtctgtggtaatgacattcggtatcggtggaatgttgattaacgtgggcgagttctcactcaaaggcatcagcttatgtgcggttgtggcaattatcttaaatttagtattaccaaaagagaaaactgaaaaaacagaataaattcattggtaaaatttagaaaaatcaaaccgcttgttttgtaaaacaagcggtttttttcatcagaataatgaagtattgtcttcacacaacacgaacaaacaaggtaatgccatcaaccttttctacttgaatgttatcgtcaactttcagtgtgttgccaattactcgccaagtcgtgtcaccaaatttacctcttgcaacaccgctgtcgagtacttcaacaacagtaccctgtaagccgaccattgcgtgatctcgagcatttaaatcggcttgttgatcctcttgctgatctttgctgtgctggtatttccaccaagcgaggctaaatagaatggctaagaccgcaaaaatagtggcttgccagcccaattcgatattagggaataatatgagtagtattgcaacaataatcgctgcaaatccccaccacattataaagatccctgcaatgagagtttctagaataagcaaaataaaaccaaaaatcagccaagcagtccagcccgaaagccattccatatttcccccttatttcttatcgcctttaagtaattcagcaatgccagccactgatccgattaaattacctgcctctagcggcattaaaacaactttactattgtcggcagcaccaatttcacgcagtgcttcagtgtatttttgtgcaataaagtaattaatcgctttagtgtcaccgcttgtaatcgcttcagaaaccatttgtgttgcttttgcttctgcttctgccgcacgttcacgggcttctgcttgtaagaacgcctcttgtcgttcaccttctgcttttagaatacgagcttgtttttccccttctgcacgcaaaatttctgcttgacggatcccctccgcttctaaaatatcggcacgtttattacgctctgctttcatttgtgcattcattgcttcaactagctctttcggtggacgcacatctctaatttcaatacgcgttactttgacaccccaaatgtttgtggcttcatcgacaatggctaataatctaccgttaatcaaatctcgctgtgaaagcatatcatctaaatccatagaaccgagtaccgtacgcatattggtcatcgttaaattgataattgcttgttctaaatgattaacttcataagcagcacgacgagcatcgatcacctgaacaaagcaaacggcatcaattgccacactcgcattatctttggaaatcacttcttgtgatggaatatctagcacttgttccatcatattgattttacgtccaaccctatcaataaaaggaataacaatattcaaccctggggttaatgttttggtataacgtccaaaacgttctatggtccaatgaaatccctgcggcacggttttaattgacgatagtaaaatagcagtagtcaacataacgaagacgaagggtaaaatcatcaattcagataacatcatattctccttaatataggttaaacaattgcctatatattagtctatttttcctgaaattctaggggtttttacaatttcagcgtataatttcgaacattttcaaatagatactttaaaacgatgaaaccagcaacagcgacgatcaacggtagtgccttacgacataatatgcgtttaattaaatctttggctcctcaaagtaaaatttgtgcggtagtcaaagctaatgcttatgggcaaggtattagagccgtgattaagaatttagaagatcaggtagaggcttttggtgtcgctcgcattaaagaagcattgactattcaagaaagtggctatgcaggtaaaatcttattgcttgaaggtttttttgatcgtgaagaattattaaaaaccctttcccgtcgtttcgatactgttattcattgccttgagcaacttgaactgctcgaaaatgtggctcaagagtggcaagcggaaaagcagaaaggtttttggcaacgtaaaaccaaaatttatttcccgattactgtttggcttaagattgatacaggtatgcatcgtttaggtattcaccccgaacaagttgcagaattttatcaacgtttaaccgcttgtcctctcgtagaatgtattcactttgtcagccattttagtcgagcggatgagcttgattgtgattataccgaaaagcagattgctacttttgaaacggtcagtcaagagtacaaggttgagcgtagtatttctgcttcaagcggtattctttattggaaacaagcccattatgattgggtgcgcccaggcattattatgtacggcatttctccacactcaacgccaattgttgatttaggttttaaacccgtaatgacattatcttcttctctaattgcggttcgcagccacaaagctggtgagcctgtgggctatggcggatcttgggtaagtgataaagacacaaaaattggtgtggttgccattggttatggggatggttatcctcgaaatgcccctgaaggtacgcctgtttttgttaatgggcgtaaggttcctattgttggacgtgtttcgatggatatgatgaccgttgatcttggtgttgatagtcaggataaagtgggtgacgaagttgagctttggggggataaacttttaattgaagaagttgcggaagctattggtgtcatcaattatgaacttattacaaaattaacacctagagtaattattgaatataaagagagtaatgctatataacataaagagcttagtttgaatttaaactaagctcttctgctgaattgaatagtttgcaataaagactttaggtagtacgattttgaggattagttaacagtcactctcgcaaacttacgtttaccaacttgataaacgaaagtccctttctgtgcgttttgtttcacatcatcgactttttcgccatcaatttttacaccgccttgttgtgcagagcggattgcttctgatgttgaaggcactaagcctgcttcttttaataatgtcgctaaaccgatttcgccttcaaaggtaaattcaggcatttcatctggcattgcccccttttggaagcggttgataaactcttgttctgccgcatctgcatctgcttcagaatggaaacgagcgataatctctttagccaatagaattttcacatcacgcggatttttacctgcttccacatcagcttttaactgtgcgatttcggttaatggacggaatgaaagtaaattgtaccaatcccacatcagttcatcagaaatcgacataattttgccgaacatttcatttggtgcttcggtcacgccgatatagttaccaagggatttcgacatttttttctcgccgtctaaaccaacgagaagtggtaatgtcattgcaacctgtggcttctgtcctgctgctttttgtaactcacgaccgattaataagttaaaggtttggtccgtaccgccaagctcaatatctgcttctaatgccacagagtcgtgaccttgcaataatgggtagataaattcgtgaatagcgatagattgattattgttaaaacgttttttgaaatcatcacgctctagcattcgagccacagtatagtttgatgctaggcggatcataccaatagtgcctaactcacctaaccactcagagttaaacacaatacgggttttttgtggatctaaaattttatagatctgctctttataggtttccgcattgcgtaatacatcttcacgagaaagtggcggacgagttgcatttttacctgacggatcgccgactgttgcagtgaagtcaccgattaagaaaatcacttcgtgaccaaaattttggaattggcgaagtttatttaacacgactgtatgccctaagtgaatatctggagcggttggatctgctccaagttttacgcgtaacggacgattttcttttaatttctcaattaaatctgcttctgaataaacatcttctatgccacgtttaagttcagcgagaacggtttcaatagattgtgtcattattattccttttactatatgcgaaaaatactggctattatagcggagaacgaagaaaaaaggcgaaaaaaacgcctcattttgtgggggaatgaggcgtaagagttggagtgattacctattatttttgaggtggctagatgataataattatcataaaggtagacaagtttgtttacataattttacaaatttaagtggcttttcaaaattttattatttggagaatactattcaaaatccgcttatccgaaatcgggtattttgtgccaagctgttgggcgaacaggctgacacgcaactcttcaatcatataacgaatttccaagacttcatctgaaatcggtttggattttggcagttttgccaacagttgttgataggcgttttgcacctgttccactcgcaacattttggctcggtcagcattgctatcaaccactaacttatccaaccgcttgtcgatagcggtgagatagcggtgtaaatctgcaaggcgtttgtagcccgttttggtgacaaaatcagggtaaatcaagccgtcaatttgtgctttaatgtctgacagggcaaatgccatcgtgaaatccagcttaccttttaggcgtttgttgatttcataggcaagggtgagatttttctcaacctgtttggcaatctcgaccgtggtgtcgtttaaattcgctctaacgtagtcgtgaagggtgttaaatttttcttccgaccagacaaagccaccaaactcttccatcaatttatccaccgcacaggcgatacagtcgtcaattagctctaacaccttgccgaacggagcaaaatataaaccgagtttagctttattcggcaatttttcgtgcagatatttaatcggcgacggcacgttcaacaataataatcggcgtaagcctgcttgcattgctttggcttgctcaaattccgtttcaaacagcttgatcccaacggcatctttttcatcgacaatcgcagggtaggctttcacgctaaaatgctgttttttctgttcgtaaaattgtggcaaatctgcaaaattccacaaatgcacaccgctttgctcaatgccgtcatcggcaatgttagacagggtattttgcacttcgtctttcaagttaaattttagctcatcaagattttcactttccgcaaggcttttacttttttcatcaatcacacggaagctgatccgcaaatgcggtggcagttggtttaaatcccactgttcaggctcaactaaaacccctgtcattcggcgaagttcataactcaaactttccaacaatggttttttaaacggctctgcacgagataaaaacgcttccgcatagtttggtgcgggtacaaaactacggcgaatagctttcggtagcgatttaatcaatgcaatgataagctcttgacgtagtcctggaacgtgccaatcaaagccgtgcgtatccacttggttcagcaacggtaacggaatatgtaccgtcacgccgtccgcttgcgagccgatttcaaattgatagatcagcttcaacttaagcgaaccttgataccagaaatttgggaagtctaattcgctgactttgtttgcattatcattcatcaagaacgatttttcaaagttcagcagttcaggatctttctgtgacgcttttttccaccagctgtcaaaatgtttgctggaaacgacatctgtgccgatccgctgatcgtaaaattcaaacagcacttgctcgtccactaaaatatctcgacggcgagatttatgttccaactcttcgatctctttgatcaagcggttattttctttgaaaaatttgtaattattgtgccattcaccttccaccaacgctgagcggataaaaatttcacggctgacaacaggatcgattgccccatacatcacaggacggctggcgataatcggaataccgtagagcgagactttttcatcggcaaccaccgccccttttgatttcgcccaacgtggttcgctgtagctggatttggttaagtgtttggcaagcggttcaacccattcaggctcaattcgtgccaccattcgcccccacaatttagtggtttcaaccaattctgccgccattacccatttcggctgttttttgaaaagcacggaattagggaacagataaaaatgtgcatttcttgcccctaaatagtgcattttttcgttgtctttcaagccgatatgcgacaataaacccgataataaagcggtatgaatttgctgataatttgcaggttcactgttaatcggcaagcccatttcacgcaccgcaaggcgaagctgatgataaatatcctgccactcacgcactcgcagatagttgagataatctttttggcagagcttacggaactgatttttggtgagttccttttgttgctcttgaataaaatgccacaggttcacaaaggctaaaaaatcgctctctttgtcggcaaaacggcgatgtttatcatctgccgattgctgtttttcctgcggacgttcacgaggatcttgaatagataacgccgatacgatcatcatcacttcgtgcaaactaccatttttcgccgcttcgatcaccatacgacctagacgaggatcgatagggaattgggcgagttggcgaccgatgttggttaatttctgtagggacgcactgcgtgtgtccctacccaaagcccctaattcttctaaaagacgaataccatcttgaatatgccgttgatctggcgcatctacaaacggaaacgaagcaatatccgtcaaacccaacgccgccatctgcaagataaccgaagccagatttgtccgcaaaatttcaggatcggtaaactgcggacgggcgttaaaatcgtcttccgaatacaagcggatacatatcccctccgaaatacgtccacaacgccctttacgctggttggcggaggcttgcgaaatcggctcaatcggcaaacgctgaactttggtgcgataactataacgagaaatgcgagccgttcctgtatcaatcacatatttgatatttgggatagtcagcgaggtttccgccacgttagtcgccagaataatacggtttagattgcttggattaaaaatgcgttgctgttccgcggcagataaacgggcatataacggcaaaatttccgtatggcgaagttcctgcttctgcaaggcttcggcagtatcacgaatttctcgctcgccgttcataaaaatcaaaatatcgccccgaccttctgcttgcagttcgtccactgcattgagaatgccttgcagttggtcttgatcctcttcttctacaatcgggcgataacgcacctccacaggataagttctgcccgacacttcgatgatcggtgcattgttaaaatgtttagaaaaacgttccacgtcaatggttgccgatgtaataattaccttcaaatcagggcgttttgctaaaatttgtttgagatagccgagaataaaatcattgttaagcgaacgttcgtgggcttcgtcaataattagcgtatcgtattgattgagatagcggtcgttttggatttcggcaagcagaataccgtccgtcatcaatttgacaagagtgttatcgctcatctgatcgttaaagcggactttatatccaatagtcgaacccagttccgatttcagctcttcggcaatgcgtgtcgccaccgagcgagctgcgatacgtctaggttgcgtatgcccgattagccctttcaccccacgccctagttccaaacacatttttggcaactgagtggttttacccgaccccgtttccccagcaatcaccactacttgatgttcggcaatcagttttaagatctcgtcatggcgagcggaaacaggcagatcagggtactcaattttcagttgttcggcttgttgtttacgcgtgagatagcgacttttacaagcggtcaaatccacctcaatttctgcaatgatggcttgtttagcgctttcatttttgatattcgccaacccacgaatacgcccagctaaacggcgagcatcaattaaagtggtatcttgcagttggttaagtaagtttttttgttctgctgtaagcggttggtttttatgttttttttgcatatttcaatggtaaattacgattttcctataatgagcgacaaaatcccagccgcaattaacggaccaacaggtacgccttttaagaaagcaacaccgataatagtgccgattaataaccctgtgactagcacaggttggttgcccattagggttacgccacgtccgccaagccaagcaactactatgccagcaataatagcaacgatcattttccaattaatcagttgaacaagttcaggcaaggcaattcgccctgatacaagaggggcaagtacgccgatagtcagaatgataatgccgattttgataccgtattgatcgagataaggcacatattttgccaataatgtttgctgcataatcaataggacggcagcggaaatggttacagcactattttggctgaaaatgccaagtaagataagtgcaacaagcagtagggcaacagaattaaattgtagtgacataggtttatttaagatgaaaatcccttacttgataaacaaataagggattgtgtttttctttggttagttgataaatcgcattagtcccataatcaaactcattgctgctacaatgatacctgccattttgtacatcgtatctgtgagccgagtttctaactgagctaattttgtatcaaactttgcttccatttgtgtcattcgtagctcaaaatcagccttacttaataaagttcgttggctttgttcaagagcgtcgtctaacgcatcagcaaacgcctcagcaaacgcctcagcaacctcaggtggttgattagcttcttgtagcttttttacaaagcgaagtttatcaaatcgaatactcatagttgcgtccattttttattcccttcgtaattagtgttatcaaaaaataacataaatcacgcaggtatttggggctaattttgtgatcgccgtcgaaaaacagaaaattaactagcgaccattaccattgcaggacggataacacgtccgtgtagggtgtaacctttttgtaagactacactaatatggttagcttcaatgccttcagctggttgcattgaaattgcttggtgtagctctgggttaaatacttcacccaccacgccgactgcttcaataccaaagttatttaaggttgaaactaagcctttatgggttaattctatgcctgattttacgctttcatctaccccttcaagagcctgcaaaccacgctctaggttatcaacgacagtcagcatctctttagagaatttttctaaggcaaatttatgggctttttctacatcttgttctgcacgacgacggatattttcgacttccgctcttgcacgcagttgaatatcttgttcacgtttatccgcttcagcaatataggcttctagctcttgtacacgagcaatcgcttcttcaagcggatcgatttcatcattttgttgcaactcaggttcaacgttttgtgtttgagcttcctgagcctcttgtgctaattcagttacttggctaacgtcttgttctacttgttctttttcagtttggtttgtcattgtgtatcctcaaattttgacttcgcaaatttttgcactaaaacgaccgctaatatagcgacaaattacgggatttcaaggcttaaatgattattttccattgttatctgttttcttgggtctgttttcgctataatcgccacaattttttccaaattttataagaaggataactagatatgatgcgttctcattattgtggtgtgttaaaccgtactcacgttggtgagcaagtaacattaagcggttgggtacaccgtgtgcgtaaccttggtcgttttatttttatgcaaattcgtgaccgtgaagggatcgtgcaggttttctttgatgagaaagatgaagccttattcaaacaagcctctgcattgcgtgcggaagcctgcgtgcaaattaaaggtgaagtgattgctcgtgatacatctcaaattaataaagagatggcaacaggtgaaattgaagtgttggtcaaagaacttgtggtgtataacaactcagaagtgctaccgctcgatttcaatcagaacaacaccgaagaacagcgtttaaaatatcgttacttagatttacgccgtcctgaaatggcggagcgtttgaaaacccgtgcaaaaattaccagctttgttcgtcgttatatggacgacaatggttttctggacattgaaactccaatgctcaccaaagcaactcctgaaggtgcgcgtgactatttagtgccaagccgtgtgcataaaggcaaattctatgcgttaccgcaatcaccgcaattatttaaacagttgctcatgatgtcaggttttgaccgctattaccaaatcgccaaatgtttccgtgatgaagatttgcgtgcagatcgtcagcctgaatttacccaaatcgatgtggaaaccacctttatgaccgcccctgaagtacgtgcaatgatggaaaaaatgatccgtggcttgtggttagatcgcttaaatgtcgatttaggcgagttcccacaaatgacttttgcagaagcaatgcgtcgttatggttcagacaaacccgatctgcgtaacccgttagaattagttgatgtggcggatattctaaaagatgtcgaatttaaagtgttcagtggtccagcaaacgatcctgaagggcgtgttgcggtcattcgtgtaccgaatggtgcggaaattacccgtaaacagattgatgaatatactcaatttgttgggatctatggcgcaaaaggcttagcgtgggcaaaagtgaatgatgtaaacgcaggcttagaaggcttacaaagcccgattgctaagttcttaactgatgatgtggttaaagcgttactcgctcgtgtcaatgcacagaacggcgatattatcttctttggtgcagacagtgagaaagtcgttacggatgcaatgggtgcgttacgtttgaaagtaggacgtgatttaggtttaacggatctcaccgcttggaaaccgctttgggttgtcgatttcccaatgtttgaaaaagatgatgagggtaactggtcagcaatgcaccacccattcaccgcaccaaaagatttaagccctgaagagcttgtgcaagatccaaaaggtgcagtagcaaatgcttacgatatggtgattaacggctatgaagtaggcggtggctctgtgcgtattttcgacccaaaaatgcaacaaacggtgtttggtattttaggcattaacgaagaagaacaaaaagagaaattcggcttcttacttgatgcgttaaaattcggcacaccaccacacgcaggcttggcattcggtttagaccgtttaacaatgctaattactggtacggaaaatatccgtgatgtgattgccttcccgaaaacaacggctgcggcttgcttgatgaccgatgcaccaagtttcggtaacccgaaagcgttggcggagttggcaattcagacaacggtggaaaaagaatcgtaagctgtatccgatttgagagtgtggtttttttgcactatttaattattaagggctgacaatgggttagagccagagtcagctttttgttcaattaaagtattctttattgagtgttgtgatgatatttaaattacttaggataatcttcttttacaggattgtatttttgcctacgtaagatatacataatattatttgggataatttatgctttttgaggactcagtaaactttgctttttgcctgcactaatgtaagtcttaaatataatatttgttgcttagtatttctttttttcatatttctaataattaatagacattttgaataaattaagagcacacaagaaaattttttaaaaaagtgctagacaagcgagagtgaaatcactaatatacgcctccgttgcgacgcagtactgaaaacaacgcgttcgtagctcagttggatagagcgttggcctccggagccaaaggtcgcaggttcaaatcctgtcgagcgcgccagaggtaatgcaatatcgactagagatggtggctatagctcagttggtagagccctggattgtgattccagttgtcgtgggttcgagtcccattagccaccccattaaatatatgcagtagcatatcagacggcgagtagcgcagcttggtagcgcaactggtttgggaccagtaggtcgtaggttcaaatcctatctcgccgaccactttatttcgttctttaacaatttatcagacaatctgtgtgggcacttgttgattgactttgtttaaaaatattttttaattttgaagtcttgataggtgcttaacttgaaattcataatgattgaataaattcagtcgtgattttttatagtcagtacatattgagcgattaaactttttaaattgaagagtttgatcatggctcagattgaacgctggcggcaggcttaacacatgcaagtcgaacggtagcaggaagaagcttgcttctttgctgacgagtggcggacgggtgagtaatgcttgggaatctggcttatggagggggataactacgggaaactgtagctaataccgcgtagtatcgggagatgaaagactgggaccgcaaggccagttgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaagggtggtgttttaatagagcactacattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgagcttaacttgggaattgcatttcatactgggttgctagagtattttagggaggggtagaattccacgtgtagcggtgaaatgcgtagagatgtggaggaataccgaaggcgaaggcagccccttgggaaaatactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagaactcagagatgagtttatgccttcgggaacttagagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggtgcatacagagggtgacgaagccgcgaggtggagtgaatctcagaaagtgcatctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaactgaaagggggcgtttaccacggtatgattcatgactggggtgaagtcgtaacaaggtaaccgtaggggaacctgcggttggatcacctccttacctgaatgaagagatttgcaagtgttcacacagattgtttggtaattgtagacaagaaagagaacgaagacatccttttgggtctgtagctcaggtggttagagcgcacccctgataagggtgaggtcggtggttcaagtccactcagacccaccactctaaacggtgaagagaaatcgatactgaatagtgagtgaaacgaagaaagcgatgtgatgacattggggatatagctcagctgggagagcgcctgccttgcacgcaggaggtcagcggttcgatcccgcttatctccaccaatcatcatatttaagcgaacagtgagttgtttatttaaatatgatgattagccgaaaggtgattatcgattgttctttaaaaaattggaaacaagctgaaaactgagagattttctgtaggggcaaatcatatttgccctgaaacaagaaagtctgagtagtaagaaaatcttaactgaacaaaagcggttaagtgtttagtagttaatatcagtcttaaatgttttttcttttagataaaaatgtttgaggttgtatagttaagtgactaagcgtacacggtggatgcctaggcaatcagaggcgaagaaggacgtgctaatctgcgaaaagcttggatgagttgataagaagcgtttaatccaagatatccgaatggggaaacccgatggatgaagaatccatcatttcattatgaatccatagtaatgaaaggcaaaccgggagaactgaaacatctaagtaccccgaggaaaagaaatcaaccgagattttgtaagtagcggcgagcgaaagcgaaagagccagtgagtgatagcagcaaagacagaagaattggctgggaagccaagcgacacagggtgatagccccgtattcgaagtttttgttgtggtactaagcttgcaacaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagccctttggggtgactgcgtaccttttgtataatgggtcagcgacttatattttgtagcgaggttaactgaataagggagccgaagggaaaccgagtcttaactgggcggatagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttatgtgaataccttcgggggtagagcactgtttcggctaggggtccatcccggattaccaacccgatgcaaactgcgaataccgaagagtaatgcataggagacacacggtgggtgctaacgtccatcgtggagagggaaacaacccagaccgccagctaaggtcccaaagtctatattaagtgggaaacgaagtgggaaggcttagacagctaggatgttggcttagaagcagccatcatttaaagaaagcgtaatagctcactagtcgagtcggcctgcgcggaagatgtaacggggctaaaatatagcaccgaagctgcggcatcaggcgtatcactaatacgccttacgattaacaacatcgaatgaagtgaaacggaaagagatgttggtcaagcaacccgaacgttgagtcggaaagtaatcgaagagaggattattagtgatacgtctgttgggtaggggagcgttgtgtaagcggatgaaggtgaatcgagaggtttgctggacgtatcacaagtgcgaatgctgacataagtaacgataaaacgagtgaaaaactcgttcgccggaagaccaagggttcctgtccaacgttaatcggggcagggtgagtcggcccctaaggcgaggctgaaaagcgtagtcgatgggaaacgggttaatattcccgtacttggtaaagctgcgatgtggggacggagaaggttaggttagcagactgttggatgtctgtttaagttggtaggtggggagtttaggcaaatccggacttccataacactgagagatgatgacgagtttctacggaaatgaagtaactgataccacgcttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgctggcgtaggttgtaggagtatacctccgaaggctgaaccagtcgaagataccagctggctgcaactgtttattaaaaacacagcactctgcaaacacgaaagtggacgtatagggtgtgatgcctgcccggtgctggaaggttaattgatggtgtaatcgaaagagaagctcctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctaagaagcagtcacgccagtgattgtggaggcgtccttgaaataccaccctttaacgtttgatgttctaacgaagattgcgaaacgcggtctcggacagtgtctggtgggtagtttgactggggcggtctcctcccaaagagtaacggaggagcacgaaggtttgctaatcacggtcggacatcgtgaggttagtgcaatggtataagcaagcttaactgcgagacagacaagtcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggagaattgagaggggctgctcctagtacgagaggaccggagtggacgcatcactggtgtaccagttgtctcgccagaggcactgctgggtagctaaatgcggaagagataagtgctgaaagcatctaagcacgaaactcgccttaagatgagttctcccacacaataagtgtgtaagggttgttggagactacgacgtagataggtctggtgtgtaagcggtgtgagccgttgagctaacagatactaattgcccgagaggcttaactatacaacctcaagcgtttttgaagtagacgtgagagagttagagagctaaatagaaacgaaaagactaaacaaaactcagagaacagcttgtttcgaataagaatagtgtagataccataagacacaacaaattttatttcataaatgtgtctaaattaaatgctgtttgtttttgcaaaacagcctgtgcaatagtgactaatttacgcattaaagccgtgataatcaccattttaggtttgccgcattcaagcaatcgaagtacaaacgagcgatatacgctgtttttgtagctgccaaaggcaaagttcattgcagggcaaaagagtgccttacgaatgtcggattgcccgatttttgaaataccaataacggtatttaaactttttcccgaacttttaatcatcggggttaaacctgcaaaagtggcggctgctttcgcgtttttaaaacgattgccatcacctaaatgggcaatcagttgaacggcggttgcaaagccaatagcaggaatagtgcaaagtaattttacattgtttttcaatgtattatctgcattaatgcactgtttaattgttttttccaaagccttaatttgcgctttgatgaaggcaatcatctgctgtgttgaagcaatgcaatcgctgtcaagcaacatcgttagccgtgttttttcttgtgccaactgttttttcaggtggtcaagttggcgatttttacgcaacaattcccgttgagcaggtgaaattggctgataaatcggtaatttatgacgcttttcatcggcataatcagcaagcatttttgcgtcgattttgtcggttttagagcgtaaattatcggttttcgtgaaatttgcactgcatttagggttaatcacgctaacggtgatttgctgttggaacagaaaatctgccaaagcttcgtgataaatattggtggcttcgatcacgcagtgaaaagtttcaccaaatgtattgagccattgcataagtgattgaaatccttccggattatttttaaacactttatgcttatgtttgccattttgtaatttaatggcaacatcaaatttagctttggcaatatcaatgccaacgtaatataatgggttatccatttgacctccaaaccttgtgaatgcgggctacggaaaacgtgcctgagataccattcggggtgatagtggatgagaaagtaggcttatatctacactacgtgcttaatggcacaaggggcaaagcaactctactttctctataaccccattatgaaggtactcgtaatggggttttcttttgcccatattctaatacaaggggcaaattatatttgcccttaaagaacagaaaaagaagatagagagaatcatcaaaagattttcctgatggccatagtgctgtggaaccacctgattccatcccgaactcagaagtgaaacgcagtaacgccgatggtagtgtggggcttccccatgtgagagtagggcaccatcagggcattaatttaaaccccagtagagatactggggtttttgctttttgttcgggaaaacaaaactaagggattttaacccaattaatctttttcaagtttataaaagtgcggtggaaaaaattgagttttttcgttgaatttgacttcataatgtagatatttctacaattatgttatagttttgttaattattaaccaatataaggaatttatatgtcagcccagaagcttattagtacactcactcaaattgtgggggagaaatatattattactgaagcctccaaaacagaagtttatcgaagtggttatcgttttggatcaggaaatgcacttgccgttgtacgtccagcgacattactagagttttgggaaatattaaaggcttgtgttgcagctgatgttatagtgattacccaagctgcaaatacggggttgacagggggttcgacaccgaatggcgatgattatgatcgggatatcgtgattattaatgcaatgagaatcaatggaattcaacttattaataatgcgagtcaggttgtgtgtttgcctggttctactcttaatgctctagagaatgcattaaaacctcacaatagagaaccacattctgtaataggctcatcatgtattggtgcatcggttattggtggtgtttgcaataattcgggaggggctttagtacaacgaggaccggcttataccgaaatggcactttatgctcaattaaatgaaaaaggtgaattagaacttaaaaatcacttagggattgatttaggtgaaacacctgaagagattttacaaaatctacaagaacagcgttatcaacgtaaggatattcaactagaatgtggaaaaggacatgatcatgcttactgtaatcatgttcgtcaagtagacgaagattcacccgctcgttttaatgctgatccggctcgtcattatgaagcatctggaagtgcagggaagttagctatttttgctgtacgtttagatacttttcctgcagaaaaagaaacggctgtattttatattggaacaaatcgaactgaagttcttaatgatattcgccgttatatgctagctaattttcagcagttaccaatttcaggagaatatattcatcgtgatgcttttgatatggctgcagaatatggtaaagatacattttgggtaattaaaaagctgggtactcatcgtttaccaatgttattcgcactaaaagcgagagtagaccgtttagctaaaaaatatcattttttacctaaccatttgagtgataaagcattacaattaatttctaaagtattaccacagcatttacctttaagtcttcgtcaatatcgagataagtatgaacatcatttaatcgttaaaatgggggggggggaggtgttacagaagcaagagaatatttaaaaacctacttcgcagaaagtgctaaaggtggttatttcgaatgtaattcggaagaaactcaagcggcaatgcttcacagatttgctgttgcttctgcggcagtacgttacagagctattcatgaaaaagaggtagaggatattgttgctttagatattgcgttgcgccgcaatgatagtgaatggtttgaagtattaccaacagagatcaacgataaaattagccataaactctattacggtcattttatgtgccatgtttttcatcaggattatattgtgaaaaaaggtcatgactgcgtagcattagagcataaaatgttagaattgcttgaccaacgtggtgcccagtatcctgctgagcataatgtaggacatttgtatgaagcaaaacctactttacgtaaattctatcaacatcttgatccaacaaatagttttaacccaggtatcggacaaacttcaaagaaaaaatattggcaatagctgagatatattcgaagatttagtacaagattgatataacaacctgtgtttcttgtttgatacaggttgtttttatttggcatagtagacaaaagtgttggtaaaaagtgacttgaagccttatactacaaggcttcaagtcctcattttgattcttgctgacaacctctaactcattgattccattatgattatattttgaaatcaaaataatactcaacgttatttttgtaatgaatgttataaaacgtttatcttaaaatctaaattagatccaattaaaatttggactgattacacatccggaaaacaaacctatcaacaacttgccgaaaaatatcattgttcggttagaactattcaaagatatattgataaagtccctaaaacagctttaaaactaccttcaaatcgatacctaaacatcattatggatacaacgtttttctgtcgttattttggcgtattagtgctaatggattctaattcaaataatgtgatttcacattactttgtgcgaaccgaaaaagatatttactacaaacttgccctgaataggttaagggaaaaaaggctatataattcaatcaattaccttcgatggttggagtggtttgatgaaagatttatttaatacgccagcacagatgtgtcaatttcatatggtggagattatgatgcgaaaattaagaaaaaagcatcaatcgcaactatatgagatagcatatgcattaaaactgacatagtaaaaatggtcgctatgcctgaaatttagggctaacttacatcagcacctaaattcgtgtggagatgtattaaaatgaatttaaggtaacaacgctagccccaattctttcaaaaatacattatgtttagctgttgcaactttgatttttgcatccaaatccatcaatacctgatgattggcggctaaatcaatttcttcttcaacagcggtattattaacatagcgggcgatgtttaggttgtagtcgttatcttcaatttcctgcacggaaatgcgtttggcatagccttgtgtttctttgcgatattgataatgttcgataatttttgcgatatgctcgtcagtcaaacggttttgacgtttgcctttttcaaaggcatcagctgcgttgacaaataaaatatcgtcttcttttttgcattttttcaacaccaaaatacaaacaggaatccctgtggaataaaacaaattagctggcaatccgataaccgcgtctatatttccatcgttcagcaatttcttacggattttttcctccgcccctccacggaacaatacaccatgcggcaaaataatagccattgtgccgttatcacttaaaaagtggaatccgtgcaataaaaaggcaaaatctgcagctgatttgggagcaagcccatagccgttgaagcggaaatcattggccaaatcttctttgggatcccagcggtagctgaacggcggattggcgacaacggcatcgaattccagtttttttgcaggattcatttcattcagaatatcccaatcattgattaaagaatcaccatgatgaatggcaaattccgtatccttcaccccgtgtaacagcatattcattctagccaagttgtaagtggtgatatttttttcctgcccgtagattttgccgatatgtccgccgttttccgccatttgatgacgcacattgagcagcaatgaaccagaaccgcaggcaaaatccagcacgctatccagttttttcttcttaccgctggcggggttttggctatccagcgttacgatttgcgataaaatagtggaaacttgttgcggcgtataaaattcgcctgcttttttacctgaaccagaagcaaattgggcaatcagatattcataggcatcacccaaagcatcgctgtcggcagaaaattcactgataccttcagcaatacgtttgacaatttcagccaatttgttgttgcgctccgtatagctttttcccaacttttccgaattcagattgatttcggaaaacagcccgccaaacgtgctctcaaaagattcgttttcgatatatttaaaaccctgttgtaaggtgcttaacaactcagtgctctgcactcttgccaattcggcaatactgccccacaaatattcaggcttaatcacataatgcactttgcgtcgcatttgcttttcaaaatcggcggtaaagtcagcattttcttgataccataccgccaaaggcgtgtgcttatcatcattgcttaattgcggataatccctacccagctctttttgcgcagcgagttcgtaattatctgataaatagcgtaaaaacaagaacgatagcatgtaatcacgaaaatcgtcggcattcatcgccccgcgtaattggtcggcaataccccataaggttttgcccagttggttgagttgctcttgggtcatggttgtgtctctttaaatgaatcagggtataaatctgcgtgaaatggataagtttccaatagttttttcaaaagcatagcaaaattttctttattttcaggcagcatttctttaggttcgaacacagaataaccgccatgatttaacacaggtatcaggcgttcgtaaaactcggcatcctcaagttcaatgcattttttaaaacctgccaaaccgtgaaaatttgccgttttctccataatattacgcaaaatattgaaatgataaggatacatgggcgcattattatccaatgcgtcttttaacattttgagcatggctacatgataaaggctagcagtatcactttccaatttaacgatctgatatttatcgaaagtatttttagataataaatatttgggcgctttgcttaattcattacatagcacattaaaaaataacccatgatgcgtagagataataaattggatatcattactcggccgataattttctcttttgtaggatttaagcatacttgctaaattatgcgcgacagataccgcataattatcatccaatgaagaaatggggtcatcgatatagacatatttcacccattcataaggcgaaccctcttctttatccaaactaagttgcaggattgccaagaaaaagcaccaaataaaaatatgctcttcgcctcgtgaaaccttaatattttcgtcaggattatccgagctgaaaaaagcaacctcccatctttctgtttctgtattctgattttctctggtcatcttgaaatcaaaatccacatatttttgtaagagcggacggattcggttatccaattccaattcccaaatacccgaaaagaaacgggaagaatcattcaacaccaatacacgatcggtatcgttttgcaaatcgttatcccaataaaataaatcctcggtatatgcgttaaagtacaaggtatcccgatgattattcgacttgccaatatctttaaaagccatagacaaacgggttttccccgtaccgttatgggcaaaaattaactggcatttgctgttttgtgttcgcagccgccttgccagatcctgtaggtcagttaaattttcaaatgaatcattattttgttgattatttcgaggcatatttggtttctctattattgttgctctcactgttctcatcgctttgtaatacggtagaaataacggattacttatttactgtatcgttggaaataactgctgcatcaagcctttcttatgggttttcagacggcctatccgttcgttttgttcgttaattagattatccagtgaagacaggcaatctgcgatggcttgttgttctttaggtattagcattggtaaaggcatagacatgaaatcattatttgtaatattcatacgatcgtatctagccccactatttgaattttgctgtaaatacttgtgccaagtattggttttaaaaaaatactcataaaaatcgttttgttcatttttaaatctaaaaactgtataaagtggtgacattacaccaataccaactttatttttagaaataggacctacaggagctaaatttgaaatccttggattataaacataatctccaaattcaataatgtaatacccatcgagattattcttattggctatatctctatcaaaataatccccttgatcaattacaccatcatttgcagaattagttagaacacgaataatagcgttatctttatttttaaccgtaactctattagctaacacttttaattcaacaacctcccaccccttacaatttctaaattgcggaaatctaagtttcggataaactatcttgcttgcttgcttgcttgcttgcttgcttgcttgcttgcttgcttgcttgcaaatcattatggcttgggaataattgctgcatcaagccttttttatgctgttttaaggcggcaagtttttgttcctgcaattcgattaattcatcaagtgaagaaagacaatcggcaattttttgttgttcttcgaatgatggaattaaaacatttacctcattaaaaaattcttgaatcccaatattcaacaatccatgatttcttgcaccttcttgggctactttcccaatatcattattttgaacaccagcttcaaaatagtgttcaaaaaaattaccatagtttgaataactttcctttagtttgaaacagatatataaggttgaaactacacctttatcatatagcttcaatggctttatagccccataaggatatccatttgaatagcttttattgtatgcaaaatctcctttatgtagtaaatagtatcctgtaatatctttggctgagacagatttattaaaaaaatccaactgactaattaatccatattgagctgaaattgttagtacattttgattattttctttattttttagcgtaattcgattaaaaactgttgataagggacgattttcccactccaatgccgtctgaaactcaggaaaacgaagtttaggaagcactctttcttgttggttttgcttattctgttctgaagcattcattttttatactcttggatttgtatattgcttaggcaaccagccgttctacaacttggttacgttctgtccataaaatcggttcgatatcgtaatttcttagtgcgtcaatcgccgaagctgcgacttccgtttcgctattattgagcaaaacaaataattcggaattgaccgcacggttttcacgactatccgtccatttgaaaaccgtcgcttcgatggcattttttttcgggttgccgagcgtttgtaagatacgttcgggttgtttgcgcgatttggggatgacaaagtcaaacatatggtcaaagccgcttttgccggtaaatttgatattgggggtatagcgtatatccgagtgatccagccattgcaccacatcttcataaaacaggttggcaacgtagggcgaagccaaataaaacaggtcgttaaccgccagcatggcttgcaggaaattatgttttttcaaggcgaaattttcggcgctggctttgagtatcaaggtttcgccgtcgagctgaacgccgaatcctgccaaagtcatttttaataatgctttgcgtttttcgctatccaaagaacagccggaactgattaaatcgtgaatgatatagccatcatcactgagcaaaaaaccgttggcttctttgcggatataaaattgcaaacagtcgttatgacgatccaaatgcggagtggtaacctgcacccaatctttatcgatttgttttaaagccgttttgtctttcaaccattggagatattgctccatcaggctttgtatttcatcaatcatatgaataattctctttgaattaagggcttgccgataatatggcaataatccataaatctatccagtagatcataagggctgtctaacactaatttgagttcatcaggcagcggataagcccatttgtcgccgtagccttcccggtagaggtgaatatgcgggcaaataatttcttcaccatcgggattgcggtgcggcgggccttcaatatccaggcgaaccaatacaatggcttttctggcccgggtttggaaggtgattttttccaatgcgatataccctctggttacatccaagttaaaagtttcttttttatccattgagtgtaacgacaagcgtaatgaaccgcccatatagggaaatttgtattctccattgctgaaatcatatttttccaatgtcaataatgcatctgcctcttgctgtgccagcatgttatttatccttagatcgtttattcatacgccttcaagcctgaaatttcttttccttttgccatatttttcagcaagggaacgaggtcttccattaaggctaattctttaatacgccgttctttccagcttaattccaaaggttcgagcaggtcggtgagcttttcaccatcgaaaatcatgcggtttaggatttcttcgataaagcctctcaaagtatcggttgcaatgccgtgtttttgcgcaagtgcggtcagttttgcgtttgtttttgcgtttctgaatgcctgatagccggctttaacttcttgctcgttgagtgcttcgcccgctttcaggctgtctatataggcaatgatgtcgtctttttcatccatcaaatcgctgcttgcggcaactagttctactaattgcgtgcggctcatctgctgttttttcggtttggatgagttttcagcaatcagtttcatgatgtagtcgtaatcgatggttacggatgaaaacaacacaaattcaaagtctaattgctcaagctccggcgatggtggcgtttttccatataacgcttgttctttgatttgttgcgccatatccagatacacgcccttaaaagcgcgctgggtatcgcttggcaaaatattttcaattgcctgcttttgctcttcgcttaaatcggtatattgccccaactgggttttgtaacgctgcacttctttaaacagattgataaatccggcacgggcgttgtcgcctttcaggttatgtgcttcagacggcgtacaggtcaatccctgtgatgacatgaaatcttccagttgcgtcatggcgttttgcagtttggtcatgacgatttccgccggatcaacaatccagatttctttggctcggtcttggtcttgccctgaaaaacgcttgatggcttcgtctacttgcgcctgctgcccacggaaatccaagatattaccgtagggtttggcagaatttaatacgcggttggtgcgggaaaacgcttgaattaacccgtgatatttcagatttttgtctacataaagggtatttaaatatttgctgtcgaaccctgtaagcagcatatcgacaacaatagtgatgtcgattttgttgcggtgcggatagtctttatcggggtattggtggtctttaatccgtttttgcacatcttggtaatatagatcaaattcgccgatactgtgattggtgcggtattgtgcattgtagtcatcaataatggcttttaaggcggctttcttgccgttcggatcatctttattgtcttgttcctcctgaggcaaatcggcttggatttgggctatatcttgattgccttcggcgggcggggaaaacacgcaggcgatattaagcggcacgaaatcgggattatccgcctgaaacttggtttgtgcttcttttaaaatgcggtaatagtcaatcgcatcattaatggatgcggtagcaaaaatagcattgaaacgacgttcggaagtggccacatcgtgtttgcttaaaacggagtccacaatcgcctgcttggtaacgggatgattggcagatacgggcttacctccctccgccttgtaataatcaatatggaatttcaatacattaccgtcgtcaatggcattggtaatggtgtaagcgtgtaattgctgttcaaaaatatcttcggtggtctgatagaacgcatctgtgccgtcgatacgcttgtatgttgcgttttcttcaaaaatcggcgtaccggtaaaaccaaataattgtgcttttgggaaaaatttcttgattgcctgatgattttctccaaattgggagcgatggcattcgtcaaaaataaaaaccattcgtttatctttgagtgtgcttaattgtctatggtgggtactattttctttgagtgccaaccccagcttttgaatggtagttacgataactttatcggcgtaatcattcgaaagtaggcggttgactaaagtagaagtattggtattttcttctaccgaaccttcttgaaagcggttaaattcttcacgtgtttgacggtctaggtcttttctgtctactacaaacaagcatttatcaatatcgggattatttttgagtaatgtggaggctttgaatgaagtgagtgttttgcctgaacctgtggtatgccaaatatagccgttacctcggttttggtgaatacagtccacaatcgctttgacggcatagatctgatacggtctcatcatcaaaagcttttgttcgcttgctaccaacaccatataatggctgatcattttgcctaacgtgcatttttccaaaaatttatcggcaaaatcatacaagtaattaattttattgtttgcttcatcggcaagacggtataccggtaaaaaacgttcgtctgtctgaaaagcgaaatgtttgttttgattgttggcaaagtaataggtactactctcattgctcacaataaacaattgcataaaacacagtaaactgttgccgtagccgttgcctgtgtcatttttataattgatgatttgctcaatggcttttttgggtggaatttgcagggtttttagctcaatttgaacaacaggtataccgttaatcaataaaatcacatcgtagcggtgatggctgttttccgtattgatacgcagctggctgatcacttcgtagtcgtttttgcaccaatctttgatatttaccagcgtataattgagcggtgtgtcatcttcgcggataaaggtgttagtttcacgcagtctcttagcagcggcaaagacatccggtgtgataatttccaatttcaagcgttcaaattcgctatcagttaaatgaacgcggtttaattgctcgaattttgagcgaaaattttcctccagtgattgtctgtcacaaatatcttctcgaaaaatatactttaaatcttgtaatttctttattagtttattttcgataatggattcagcatagttcatcataagctctatcagttcaagcgaaattttgagaatcttaacacaaacagtaaatctattaaatctatttgactgtttccttagcaacggttttcgggcgttatttctgttaatgcgtatagtgtattgtaaggttgtcatatttactggaattatggaaaatcgacaccaaacgccactgcttgtttcacgaaatgcaacagttactcaaaaacgcttttttaaaccaagcccaacaaaaattccctgaacgagctaaaaattgggaatttcaagccactttgtttgccacttgcgttttaactgcgttacatttctattttgaacaaaatattttgcccccgattgagcaagtgcaatctgattggcgtgaaatgtttgagattatggggatataagagcagtcaagtttccataaatttttgcatttgcaaattcccccaaaatcccaccgcttgttttatctatccttacctatttcctaaaaaatctaaaatttaacttcttttaaatcaacaagttaaagataaatccaaagccttacatttttgcaagtacttccataaaataagttaagcatctattactgccctcaaattacttacttttaggaagtaaaaatgctgcttatcttattatttatttttagcttaatttttattttcactattcgccaaaaaccgcgtttactgcatttcggtacattccgttttgctaaaacgattacccataatcaacaccgtttttatcttgaaaaagtggcgtttgacaatcggcaacaagccattcacggttattttcagcttgcctcagccttgcaaaattatggcaaggtgcaggaaacggagtacgatttttttgatttttattcggtggtgctgcggtttgacgactgcacgatgaaactggtgtagcggttggagaatgtgcgtttaatcaaaagcgaaacaccgatgtccattgccgaatttgagcaacagattgccgagattgcttatcgggaggtttaagatgttacaacaagccaaacaacgtattgaacaggcggattttatggtgattggtgtcagcgctggctttttcgcagcggcaggtttaacgtacagtggtgagcgatttactcaacgttttcagccgtttatccagcgttatggtatgaaggatatgtattcggcggggttctatccccttgaaacagaagaagaaaaatgggcgtattgggcggagcatatttgggtgaaccgctttgagccgtccgcattgcccttatatcaacagctttttgctttgatgaaagacaaaaactattttgtgattaccaccaacgtggacagccagtttgccaaagctggctttgatcccgataaactctttgaagtgcaaggcaattacggcgagttgcaatgtgccaagccttgccattcacaagtttacgacaacgaaacactggtgcaaaaatggcgttcacagcaaaaaaattgccaaattcccaccgcacttgtgccgaaatgtcctgtatgtggcggtaaaatggagatacatttacgggtcgatcaccgctttgtggaaatggaacaatggcacgccgctcaacagcgttatgccacatttgccgagcaaacaatgcagggcaacacggtgtatttggagttggggattggctttaacactccgaccattattcgttacccttttgaacagatgacctaccgcaatccgcaggcaacgctgattcggttaaatcgggatcacccagaaggctttgcggaaacggcggaatttttggcgttgcaagatcagaagtagcggaaaaaggcgtggtgtcgctggcggatttaacgcctattcaaccgcagatttacctatggcaaggcgacatcacaaggctcaaagtgggggcgattgtgaatgcggcaaacagccaactgctcggctgttttcaccctttgcacgcctgtatcgacaacgccattcactcgcaagcaggcgtgcaacttcgccttgcttgtgccgaattgatggcgaaacaagggtattttgaacccacagggcaagccaaaatcaccccagcgtttaacttgccgtctgcctacgttttacacacagtcggaccgattattatcggtgcgttatcagcaaaagatggcgaactactcgccagttgctaccgctcttgcctagaactcgccaagcaacacggcattgaaagcgtcgccttttgttgcattagcacaggtgaatttcgtttccctaatcgagaagcggcagaaattgcggtgaaaaccgtcaaagcctttttagccgataacccgcaaatgaagatggtgtttaatgtgtttaaagatgtggattgggagatttatcggggttgttgaggaagcacggttgttttggcaaaggattttgctattgcaaaaatgttggaaaattataccgctcttttatgttttcgctaaataggtttcccgaaagtgtttcggagtgctttgttcgtattttttgaagaatttattgaagtgagtggctttttcaaaacccagttgtaaggcaatgtgtttcacggatttttgggtatgcaccaggaggcgtttagcttcgagcagtaagcgttggttgataaccattttggctggtagccctgtgtgaaccacgcaggttgagccgagcgttttttctgtgcagctgagctgtttcgcataaaattgaacttgatgttgttcgcaaaaatgttgttccaacagttgagaaaagcgttgccaacgttgattttggcggtctttttgcggctgatttgcagcataaagggggctatcaactattcccccctcagccttcggcagctcccccctaaagcagggggagcgaaggcattaggaaaaatatcctagtaaagcaccgctttcgcttcttcagagtcgatgttttctttcgttacataaactacaccagtatcaataactttctcgactttttcacctttaatgagtttgccgatagtatcaacacctttgtagcccatttggtatgaagattgcaccacgataccgtctaaagttccgtcacgcacgaagttttgaaggtctgagttaccatcaaaaccaacggcaacgattttacctgcgaagcctttttgtttcaccgcacgagccatacccactgcggtcggttcgtttgcgccgaagatcgccgcaatatcagggttagagcctaaaacgtcttcagtttggttcaatgcggttaccatttctgaatttgagtagtatgggccgacaattttgtaatctgctttagatttcacttcatcaatgaagccgcctgtacgttcaatcgcagaagctgcaccttgggtgaatgacatcactgccactttaccgcctttcactttggctaataatttttcagctgccaatttacctgctgcacggttatcggtcgcaaggaatgattgatagtatttaccatcgctgtttaagcctgagtcgattaatactactggaataccgctttcataggcttttctcactgctggcacaagagccactgggtcagaagccgcaagcacaatacctgctacgccacggtttacggcgttgtccaccatattgacttgagcgtcaatcgcagtttctgattcagggccttggaaagtgactttatattttccgcctaaatctgcacctgcagtttccgcacctttacgcacgttttgccagaaggtagagttagcggattttacgatgactgcgatttcgtctgattttgcccacgctgagcctgcaaaaagggtagataaacctaatacagttgcggttacgattgctaattttttcatagttaaatctcctctagagtttatttcttaccaagttttttagattgacggagctggtctaaagacacggctacgataatcaccaaaccgataacaatcatttgcacaaacgatgatacgccattcatattcaaaccattacggagtacaccgataatgaatgacccgattaatgtgccagggatggtaccgacaccgcccatcaacgatgttcccccgactactgcacttgcgattgcatctagctcgtaaatcacaccgccgtttggctgtgctgttactaagcgagaggcaaggattacgcccgttaagccagagagtaagccactagcaacataagcataaattttgacaatattcgttttaatacccgataaacgtgctgcttcttcatttgaaccgatagcatagatgtagcgacccacttttaatttagttaaagcaaaggtaaagagtaccgtgatgaagatcataataatcacaggatacgggatacctgtaaacaccactttcggtaagccattcgggccttcttccacgattttgaataaggcgccgttacctaagactgcaaaactttccggcatacctgaaaccggtgcagcgttcgtcacatagagtgctagaccacgagcaaccatcatcataccgagggtggcgataaatggcggtaacttcatttgagtaacgagaataccgttcgttaaaccacaagcccctccgactaaaataccgagtaccataccaatcggcacaggcacgccagcgtttacaatcattgcggcggcaacccctgagagcgcaaccacagaaccggtacttaaatcaataccgccggttaagataacgcaagttgcgccgataccgattaacgcaatggtggaggtttgtaagccaacggtcataatattgttggaggtaaagaaataatcgttggttacactaaagaaaatgactaagaggattaaccctgctaatgccgccattttgcgaagcagatctttatatttatcactcattttaaagctccttagtttttatattcgtttttgaacatatttttcacgccagtggcatattgcataatctcttcttggttggtttttttagtttccaacatacctgtcattctgccctctcgcatcacgataacacggtcggtaatgcccaaaatttcaggcaattcagaagaaatcacaatcacaccgacaccattggcggcaagttcatcaattaactgataaatcgcatatttcgccccaacgtcaatgcctcgagttggctcatcgaaaatcattacattcgcatcacggaacaaccatttgccgataaccactttttgctggttaccaccacttaggttgtttactaactgctcaggtgttggcgttttaatttccattttcttaataaaggtatcgctcgctttcagctcctcattatgtgaaataatgcccagctgatcgcatactttatccattgaagccattgtgatgttctcacgaatagacattcgcaccgctaccccatttagcttgcggtcttcagataggtaggcgatacctgctttaatcgagtcgcttgggtcacgaataacaactttcttatttcgaacataaatttcgcccccatcaagcggatccgccccaaaaatcgcacgggcaagttctgttcgttttgccccaactaagcctgtaatccccaacacttcgccttttaacaagtcaaagtttaacggctcaaacacgcctttacgttctgcattcatcactgaaagtaataactcatcactgattttggcggttttcggtgggaaatggttatcgagggtacgtcctaccattttggtaatgatttcatccattgtgatatctgagaaacggtggctagatacataagtaccatcacggaaaatggtaatgcggtcgcagatctgttttagttcgtccatacggtgagaaatatagacgatacacacgcctttctctttcaagcggcggacaagttcaaataatttctcaatctctttttcggtaagtgcagaagttggttcgtccataatcaacacttccacatcaaaagagagggctttggcgatttccaccatttgctgacgagcaacggaaaggtctttgactagatcggtcggcttcacatcaatatcaaacatattgagcaagtcggcggcatatttattcattttggctttatcaacaatgccaaatttatttgattcacgggcaaagaagatattttctgccacggtaagatgaggaatgaggtttaactcttggaaaatcatactgataccgtctttctgagcttccaacacagaagaataattgacggctttgcctttatagatgatatccccttcatctgcttgataaaccccgatcaagcatttcattaaggtggattttccagcaccgttttcacccattaaagcgtgggcttctcccttatgtagttcaagctgaacattctttaaggcttgaactcccacaaaagatttgctgatgttcttcattgagagtaacggcgtattgctattgactgcggtcatctctgcctccatcatgattattttatcggctatctctattgagaaaacaaccgtatattcaaacaaaattgaccgaataaaaagaaattttacgaagtaatttagtttttgtgattcagctcacaaaaaaagcaaaggttttcgttttttgactgcccgattttaagaaaaaaagaataaatcgggcaaaagatagaacataggatagggagtagaaaaaaatgaacacaattacggcagtgttgcaatcacggcatagccatccatttcaccaataaaatctacttggctattagcgctgataaaaattgcttcgccttgttgtaaataaatcgagtcatatcctaaatcgacatacaaacttccagacattactaataaaatacttgcacttgttgcagtaaattgttcttcatcaaatggtttaaagctgagtcgctgtaaggcaaagtcctctgcttctggtgttggatataagtgcagtaactcttcactattattttcctcatattgaggaataatcttaggtgtaattgctcgataatcaatcgtatgtagaagtgctgggatatctacatatttaggggttagccctcccctaatgacattgtctgaggctgccattagttcaatattttgtcctcgcaaataggcgtgaggtaagcctgcgccttgataaattccctctccctttttgagatttacaatattaaatagatagaaacagagaagccctgcatctagtttatccagacttattttcattgcatcaatagtatatagtacccaatagtcaggatcgtctagtttaagtctatcttgttgataatcctcttgtttattttcaatgatgggcaataaccattctgcaagctgagtttgttctgcttgcataatggaggcataaaccgttggtaaactttgtttttcaatcgctttcgccagaccttgtaaagattgatgcttcattaggctttctttaatcgcatcttcagatttgaacccgtgtaatagccaaaagtctgataatgcaatcatcatttctggtttatgattacgatctttataggtacggtttgaggcatttagtggaataccttcataattttcacgttcaaaaccgtgttctgcctcttttttagttgggtgaagttgaatcgaaagcggtaacttcacatccaaaattttcagtaagaaaggtaattcatctccaaattgttcacgcgatttttctcctagtatttgaggcgccttatctaaaacgcgatctaaaggcaaccatgctccttcaaattcaatcattgaaggagcagaacggtgtgctccaagccaatattctgcatagggtttctcttcgtgagtgtcaagttttaaccagttgggtatgaaaatatctccaccccaatcataatgttgatgtttacccactaatttgaaaatcattttttgtatcctccaaagaaattgacaactcgttcaatatcttctttttgtttaatccgaataaacaatcgcctattattttttagatcaatgactaaaatattctgatctgctaaattaatttgtgcaatatggctatataaaaaatagaaattgccaaagaaaaagccttgttcttttaatagtaaacgagggtaacgaatgaacgccgaatagactgctaagacaatacaaccgcataataagaatacagtgagaggttcaatacctgtttgcactccttgtacgataattaacacaattagggcaattaaaatcccggtgtctaaacttgcttgtcgaattaacggcacacttagtcgggtttcgccgtttcgtctgtccataatgagctgatcatagagaatatagagcaagctcaaaccaatagctaaaatcagaagtatatttgtcatttgtaaaatgttcttaaaaaaagaccgcttgtattctagcacaagcggtctaatttatcggattttttgcaaattatgcaagaatacctgtccacgcaccgaaaataccgataacgaagaagccgatgataatccaaagtgcattcacacggttacgtaataaccacatacatgcaaaggttaagagtaacggcaataaacctggcattaagctatctaagatagattgaacggtggtaatttccgttgtgccgtcttgtttttgaatggtagaaaccacaagcggtacattaatgcttgtccatttttgaaccaacgcccccataataaacaagccaagaattgacgctccttcggttaatttttgcaataaaccgccactcatatcttgaaccacatttaagccttttttatagccgtaaacgacgccgtagtaacgggttgctaaacgcacaaggttaaataagacgaagaaaagtagtggacctaataagctacctgttaaggcaacgcctgcacctaatgctgcgaatactggacgtgctgttccccaataaatcgggtcgcccacaccggcaagaggccccatcaaaccaactttgatcccgttgattgccgcatcatcaataggtttaccattcgcgcgttcttcttccattgcgatagttacccctaatacaggagccgctacgaatggttgagtattgaagaactcaaggtgacgtttgatcgcatctttccgctcttgtgagtttggatcgggatataaacgtttgatgaccggcaccattgagtaggcaaaacctaacgcttgcatacgctcgaagttccaagaaccttggaagagattagaacggcgtaccaccgcatttaaatcgctctgtgttacttttttgatttcagttgtcatagtcttacttccttagtctaatctgttgtcaaggtcgttgtttgttgcttgcacttgcaccacttgtttactttggttgtatttcgggtgaagttggatataaataatcgctgtgatagtacctaaaacccctaatgcaacaaggttgaaatcagtaaatgctgcaattacgaaacccgcatagaagaatggcattaagtgacctgctcgcatcatattgataaccatcgcataacctacaaccgcaataaagccaccggcaattttaagacctgttgttacaactggtggaatggctgctaacatagattgaaccgtatcagtaccagctgtcatcgcaacaatcaatgctgggattgcaatacgcattgcttgaagtaataacgctgaacggtggatccaatccagtttatttaagtcgccagtttcaacggctttatccgctgcgtgttggaaaccaactgtaatcgcacgtacaacataagttaaaacttgacctgccgctgcaagaggaatagcgagtgcaatcgctgtcggaatatcttgtccgcctacgataaccaagatggttgaaaccactgacgccaatgctgcatctggtgctaatgctgcaccaatgttcatccaacctaacgctaataattctaatgaaccaccaacaatgatccccgttttcatatcgcctaatacgataccgattaaggtacaagcgattaacggacggtgagtttgccactcatcaaggattgatcccatacctgaaatacaggcaacaaggaatactaagattatttgtaatgtagaaatttccataataatttccttagattaagttatttttcttgagtaaatccatcatatattgacggctatcattcgatactttacgcacatcaagctcaatacccttcgcatctaatgctttaaatgcttcgatatctttatcatcaacagcaacggcactggtaatcattttcttaccgtctttatatgccataccgccgatattgatcgatttgaactcaacgcctgcttccattaaacgaaccacgtctgtcggattagtgaaaagtaacatcatacgttcgttcgcatattcagggttgttataaacacggatcattttatccacaggcacaacgtgagccgttactcccggtggggctacactttttagcatcgttgaacgcacactatcttttgccacatcatcgttcactaccacaatacggctaacacggctctctttcgtccagcgagtcgccacttgaccgtgaattaaacggtcgtcaatacgcgccagaccaatcactaaattcccttcttgattgacttgagctacttgtggttgtaccggagcttgagcagcaggagcaggttgttccgcaggtgcttcttctttctcctgatagcgtaatgcacgcacgcctaaacgtcctgtttcaagagcgacttctactagctcagctaaagacggaccatcatcacgtgccataaaagtttcaacgagcatcggcacatttacacctgtgacaatgtccatattatctttgccttcagacacacggtttgccgcattaaacggactaccgccccaagtatcaacaaggaatagcacctgatcgcagtgagcgagctcattcgctaatttctcttgatatttacccataatagtttcggcattttcgccaggtacaaagtcgatagtggctacatcactttgttccccgattaacatctctgtggttttgagaagttgttctgcggcgacaccgtgggttgctatgataatagcaatactcattggttgctccttatgtgaggatttattcggattattaaaacttattctcaatagagtaaatttcggagtggaattttaaaggatgccgatttttcagcaatctgatttatataaaaatgtgatctacttctcatttttgagttaggtaagagggttatttgctgattttatgagcttatttttttattataaaaaataattatctaatttgactatggagatataaaaatgtctgtatcttatagttgtcacttcagatacagacacagattgtagttagggggatacttcaccatctatcaaacaaattaacagatatattctcagtctagctttgactcaatcaacttaactaaaaagctaatatgatcgctatttgcattcaatgctgaaatatatctgtagttatttcctcctgcatttttaaaattttcctgattttcttcagcaatttcttcaattgtttcaaggcaatctgcggcaaaaccaggacaaataaccgctatgttttttatatttttagtaggaagattcgataaaagttcatcggtataaggttgaagccactcttcactaccaaaacgagattggaaagataaaagccattgattttctgtcaaattgagctccttggctactaaacgggcagtttctcggcattgttctgaataaaagtcaccttctgcttcataacgagcaggtataccgtggaaagaaaaaagtaatagctcattctctgtaagcgttacagtatttgctaatgctttaatatacaaagggtgattatggtaattgtgaataaattcaaaaggcaaaactttcttgtgtttatataatgcttgtgcaaaagcatccagcactgaggctgttgttgttgagctatattgagggtagagtggaagtataataattttttctacatcctgtgctataaggctatcaacagcactctggatactaggattaccgtaactcattccaagttcaatgacaatattgttgttctgtgagcaaaaataagtctgaatagcggcttgctgctgacgagatatagataataaaggagagccatcttctgtccagatagttttataagcctgtgcaactttaggtactcttttaggtaacacaagacagttcaaaataaatttccaacgccacttcggtaaatcaattactcttggatcgctcaggaattgtcttaagtaacgtttcactgccggagtagttggttcatcaggagtgcctaagtttgctaatagcacaccaattttttttgatttattcatagaaatccttcatgggtaattagttatagacgtattatagagtattagcaacatcaatactatttatcaaactaacaggcaaaaatataaatagatattatatttgtcagatttatctctatagtgaaatacagaagacatattagtgcttgctttatgctactgtttaagaaaaatacaaccaataaagtgattattagataaactgtccttgtattaagttttaatgctcatatacattaaactgaaccatgattccattctgtcagagattgttgttagatctaacccttcagattgttcagtgatacgagtcagatagggatttttatttatatcaaaaatcttttttaagatttttgatggatccaattctttattcttgttattaaagtattctgtaacactatcactaagtgcccattttaattcggtttggcttgataaataatcttgtaaataaagatttaatatctccgttgcttctgtttgcgaaatatcattaaaggttaggtaatttgctttttcaccttgtcgataataaaaacgtagcgaaagaatagggtgattatttgcttttaataacaaataataaatccacgcttgaataatatctttatctcgcaatccccctactcgccataataccacttcattattaaagcaatttggaacattacccacaagttgatattttctctctgcaaaaataacagagtgttctatttcaataatgtttttctcttgcgacaaataagaagataacgtatttcttaaaagctgaatatcttcggtgagttttgttttattaatctctgcaaaataacgagcgggtagattgccttttaatttttcattctcaaaaaagagttcaatatcctgttcttcgacttgaattagatcatcaagtaaattatatctttctaggttagataattggaaaatttcactttcttcaattttatcttcattctgttcaaaacgaacccctaattgttgttgaaaaaaatattttatcggttcttgaatataagaaataaactgtgtcagtgaaatatctgacattatatcttcctgcgttttagttaatttctgcaagaaatttttgcgtggcaagatattatttttaacttccaaccactctttatcataagccactttgccatctttgaaattatttgggctaaatacggtcattgggtgaacagacaataatttagcatagtcagctttaggcaggttttctttcaaataatcaaataattgtgtcaccaacaccgatggtaatttttcttggctacttgtgagcgattgcccaatataactgatatagagcatttgttgagccgagagcaaggcttcaaggaaaagataacgatcatcatctcgtcttgagcggtcgcctttttgtggggcgtactgcattaaatcaaaactgttgatagtctgttggcgtggaaactcaccttcattcatacccaacaaacagactactttgaaaggaattgctcgcatcggtaataacgtacagaaattcaccttacccacaaggaaatttaagtggctacgctgttcgctcagctgttgagtaaatagctcaagcatcacatcaatacctatcgcttcttcaaaatggctttgctgaatttgctcaatcacatcacggatagcctgctgtaacgtcaaaatcgcatcaatactttgatcgttttcttgataggtctgtgccacaagggtaaacagctgttcttgccaagcagataggctctgtggctggcaaataaaggtgtgccaagcggtgagattgtcgataaattttgctaaattccctgttaattcagagattaatccataactttcatcaaaagctaaaatgttctgccagccattattttccgcttttaaacttgtgcctaacaataatcggtttagcccattttcccacgaattataattttgccattctgggttctctatttttaagccagatctaatgccaaccgatttaatccattctcttaatgtattaattttctgctcattaaattgatatttttctcgaatagctgaaatatcaaagagatctaatatctcttctgctgagaatttattttctttaatcgataacaattgtaaaaagctagcaataattggattaatataactaattttttgatctgataaggtaaagggaatatatcttctctctttttcataacgagaaaataccgcattaatataaggtgcataactatcaatatccgcagacatcacaataatatctttcggggataagtcaggataggtttcaaataaatataataattgattatataatacttctacttcacgcattttgctgtggcaagtgtgaagctgaatagagcgatcttcattagctaaagagaatgtagtttggtgttctgaatataaaatcgctttttttacttgggttaataatgtcggatttttatcttcaaaatgattataaagtgatatatcttgaatacctgtttcagttaataaatttaaaaattcttttccttgttttccccaaactgttaataatgggtttccttgtttttcaaataactctgctaattctgcttcagataaattatcttttaacgctaatttttctaataccttatcttcacgatcatttgcccagtattccatacttggattagtgaaaaagaggtgaacattgcaatgctcactcaattttttcaatacggcgagctgagaatggggaagggaagaaatgccaaacataaaaatccgtttcggtaagcgagctttttcagtggcagttaaattatcaagtttatcgaaataacgctgttgcaaataagcacggtgtgaagtattaaaaatcgcttcatcgctatcctgttttatatcggcaaccaacgcattccaaaggatactttgccacgccacattcgttgcaatctcttttgcatttttttgcttaaaagaaaccgctcgcataatctcatcaaccaccgcttgcgattgccccttttcccatagcaccaaccattgcggacggtacacgagatattggtcaaacagatcggcgattttctctgctaattgatactgttttagctgatcgccttggtttaaataggacgcaagtgcttcaaaggcaggttgttcaaggaactgcggaataattcgcattaaacgccacaacattgactggcggtcaaagctattctctttcggcaaatcaggaaaaagcacgcgatattgttgccataaaaaactggttgggtaaggaaattgcacattaccagccaccccgatttcttgagcaatctgcatttgcaaccattgtgccatacctaaactttgtaccagcacaatctcttgactaaatggatcggggttgggatctttcgctaagatcgcagtcaatagatttttctgttcggttatttggtttgaataatatactctaaacatagcaactcccctttgtaagcaagctattttagcgagtttggggggaatgatctatttggcaacctaatttataattagaattatagtgatgttattatctatcatataattcccaacgcatatttcaacgcccgttttttcaacggcgttgcacgttccgccacaattaacgcaacattacgcgcgactttcacaggtaataaatctgtcttaaaggttttataaaatacgtccattcccgtttgcattaacagattatcaggcttacgttttcgttcgtaaccatttaacactgcttcatctgcaaaattctgccctttttcgaccgcttgttctatcacttcaagtaaggcttttacatctttaaaaccaagattcaccccctgccctgccagtggattaatcgtatgagcagaatccccgactaagacaatcccatttcgcacatagctttgggcgtgctgacgtgtgagtgggaaactatcgtgagcggtcacttcaaccttgcctaaacggcttggaaaatggcgctgaatctctgcactcaatttctctttgctcatctgttgcagttgagcaatacgttgtggcgaatcataccaaaccacacaaccgttatgttccagtaacggtagaaaggctcttggaccgctttcaaagaactgttgccaagtgacactctgttgcggtaattctgttttgactacggcaagcagacagtgttggcgatattgccagcttgtcaaaccaatgcccgaccagcgacgcacaagggaatttgcgccatcacaggcaatcaatagcggtgcggaaaacacctgctgatcaagctcaaccatccaaacaccgttctcatcacgatttgcagaaatttgctcaaaaccaaccgcttgctgacagtttggatactgtgccaatgcttgccaaagcccaagctgaataaggttgttttccaccatataacccaacttatctaagccaagatcatttgcgtgaaaagcggtattaaagccatcaatttcccacgtttctaagccgtcataaggacaaactcgcatcgattcaatcgcctgccacgcccctaatttctccaacaaggcaacggaagccacactaattgccgaaattcgcacatcataaggtgcatttggatcaaatgtcggcaacggatttttctcaatcagaacaacctttagccctagctttgccagccccaatgctgtcgccgccccgaccattccaccgccaattacaatcacatcttgttgagtcatcgtcattttcctctcaaatttgttaggcggaagtttactacaagcggtgagatctgcattgatttttgcaaaatttttgtgaccctcgtcgaaaaatgattttctctcacttgtctttttgtcataaaaattaacaatctcgtgattacttcactatatgaagtttgcttgttattttgtattgaaaacattacaatcatagaaaatcaattatgtacattattgaacaaactgaaacctttaaattatggctaaatgaactcaaagatcctattgcaaaaattgcgattatccgtcgcttagaacgagcaaaaaacggacattttggagatcataagtcgctaggtgacggcatttatgaaatgcgattgatgataaacaaaggctaccgtatctactatgcaagaaaaggggaaatcatctatctcattatcaacggcggatacaaagacagccaagagcaggacatcgccgtagcaaaaagattctggcaacaataccaacttgaacaggaataaaatcagatgaaagataaatcgtttaacggacaaatatcaacgttcgatgctgctgagtatctcaataacgatgaacttatcgcactttatctatcggaagtgctaaaagacggtgatgaagccgaattcattcaagcgttaaataccattgcccgtgcaaaaggaatgaatgaattagccaaaaaagccaatatcggtagagaaagtttatatcaaacactttcaagcaaaaagccacgttttgaaaccattgtgaaaattctttcagcgttaaatattgagctagtgcctaaggttaaaactacccaatagcttttatcttttcactatttttgtgacactcgtcgaaaaaccacaatattaaaattgcgttccctgtaaccatctcacaataatatgatttcatcacatacattgacttcattatttgaagtcataaaatagggaaatcaaatgcgaaagaaacatcagcaaacactttatgctattttcgcaacaccaacatcatctaatatcaaatggaaagagatagaatctctgattgaagggttaggtggtgagattattcaaggtgaaggctctagagtacgatttaaactaaacaatagcattgctcgttttcatcgtccacacccatcaccagatacagataagggtgctatcgcaaacttgcgtgaatggcttactaaaataggaattactccaaatggcaacaaaacaacaacctaatattatctatattgatcattatcctgctattgtcagctatatacctgaattgaagatgtttcgtgggaaatttctcaatacgacgggatattgtgatttcattgccgatagcgtagttggtttatatcaagaaggaaaaatctctctagatgaatatctagtagactgccgtgaaaacggtattgttgcatttgagcaagaaaagcaaaaaacctttacattacgctatgatgaaaccctatcagaacttgttactcaacaggctaaagcacgtggaatttcaattaatcacttaatcattgaagctattgagcaacatttagcacaacgactttaactatttttgtgacactcgtcgaaaaaccaacattttttgctattcaaaaacagacatactttttacgctaatataaaaaagaggaaaaagtatgtctttagcgattatttacagtcgagcatctatcggtgttgaagccccattagtaaccattgaagtgcacatcagtggcggaagccctggacttaccctagttggattgcccgaaaaaagcgtcaaagaagcacaggatagggtgcgaagtgccttgatgaatgccaattttgattacccagcccgacgcattaccatcaaccttgccccagccgatctccccaaagaaggcggacgttttgatttacccattgccatcgggattttggcagcatcggggcagattgacagcgataaactcaaacggattgaactgcttggcgagctgtctttgacggggcatttgcgtggggttcacggtgctattcctgcggtgttggcagcaagtaaagcgaaacgggaaatcatcgtgccacaacaaaacgccaatgaagtttccttggtttccaatacccaaacctattgtgcttcaaccttgttgcaggttgtcaattttctcaacaatcgagatcaactgccgattgctcagcagctttcgcaaaatattgccgaaaacagaccgcttgtcagccgtgatttaaccgatattatcgggcaacaacacgccaaacgggcattgattattgccgccagcggtcagcataatctgttgtttttaggtccacctggtacaggcaaaacaatgcttgctagtcgccttgccgatctgctgcctgaaatggaagatgatgaagcaattgaaacagcatctgtcaccagtcttgtacaaaatgaactcaactttcagaactggaaaaaacgcccgtttcgttccccacatcacagtgcatcaatggttgcgttggttgggggcggttcgatcccgaaaccaggggaaatttcactggcacacaacggtgtgctgtttttagacgaattgcctgaatttgaacggaaagtgttagatgcattacgccagccgttggagtcgggagaaatcattatttccagagccaatgccaaggtgcagtttcctgcttgttttcaactgattgccgcaatgaacccaagcccgacagggcattatcaaggaacgcacaatcgaacgtcaccacaacagttaatgcgttatctcaaccgtttatcagggccttttctcgaccgcttcgatctctcgattgaagtgccgttactgccacaaggtgcattgcaaaataacaccgatcaacgtggcgaaaccaccgaacaggctcgcaagcgggtacttgaagcaagacatttgcaatttaaccgtcgggggaaaatcaatgctcaactgacgaccaaagagattgaacaagattgcaaactgactgatcgagatgcgttatttttagaaaatgccttaacgaaactggggctgtcggtgcgagcttatcaccgtattctcaaagtttctcgcaccattgctgacttggctggagaagcccaaatccaacagccccatctggctgaagctttgggctatcgggcgatggatcgtttgttacaaaggttacaaggggaaagttagttctcaaaaacctctaacaccaacttactcaaacagtccaacaacatcaactcttgattgaccgcattgacttcgcgtaaatcccgttgggtttgttgaataatttgatgccctttcagtaaaccttgagcagtcagctgttggctaaaaggcagaataccgttttgcagatcaggattgagccaacctgttgcgatttgcattttggctttcagggcatcgctgaaaaacgaacccagccattcaagctgttgttgcacttgctcaggctctttatcgaaggcagaaaagagcaggaaaacatctcggcttttgtaaaaacgccaaaaggtctgcaaaaaggttttacggcttggtaaacggtcagtttcaaggaacgttttgcaaagcaatgggcggttgtggcataaacgaagtgcggtttcaatctcacttggctgtgctgtcgggcattccgtctgtaaccattcaaatgtttgtgacggctcaggcgtatgaactaaccacgtctggcaacggctttgaatagtggcaagcattgtggcttgcaaaggggcttccaataagaaatagacattttggttcggctcttcaagggttttcagtaacgcattcgccgctgcttccgttaaacgttccgctccagccagataaactacggcatttccgccttgttgagcaaactgttgtaatttggcagtgatttctcgcacttgatcgatcccaatatctttatcatcaatcggggctaacaggtgaaaatcagggtgattgccgctctgccataacaaacagcttttgcattgtccgcaaggttggctctgttgtggcgtatggcaaagcaaccaatgggaaaaatgacgaataagctgctcagtacctagcccactgtctgttttaaacaataaggcgtgatgcccccgaccttgtaggaaggtcgaagtgatttggtggtgggtttgttgatgccaaggataaaggttcatattcattcaacaaattaccagctaatattaggctttcgttgttgagcaacacaatctttgagataaagattgattaatgtctgataaggcaaattaacctcatcggataattttttaaaataatctatcgtttcatcttcgatacgaattgtgacaactttttttgatttcaacgttgtcgcatatgggtttttgataccgttagaaaaatcatactcttctctcattgttgcctcccatattgtatagtttcttgttttgtagcttttcttgccgagataattctaagattgttgtctcgttcacaatgaacaacgacgagaatattactccgttcactgcgtcccaataataaaaaacgctcttcataaaatgaatgatcaggatctgcaataagaatagcgtgatcgtcataaaatacggttattgcttcatcaaaggtaattccgtgctttttttcattaatctccgctttctttttatcccattcaaaaccttcaatagaaaacattaatatgctccttcgtaaatatattatatttacgcattcaaaacaatcttcagattatttctcagatgttaaaaatatttcaaccgcttgttgaatatccgccgacacctgttctatcttaggttcagcgttaatgagcgccgctttcggattgtctttgactaaggatacataacgctcacgggtacggtgaaaaaagtcgatatcgagttgctcaatacgatctaacgctccacgccctcttgctcgctctaaacccatcgatggctcaatatcaaggtagatcgtaaaatcaggctcaaaatcacctaaaatcaccgaacctaccttatccactaattccgacaatccccgtccaccgccttgataggcttggcttgacatattgtggcgatcgccaacaacccatttgcctgaagctaaagcgggctcaatcaccgtttcgactaactgtgtacgagccgcataaatcatcaatacttccgctttgtcggttgtatgctcgccgtcttctccttctttccatagattgcgaagtgcttcggcaattggagttccgcctggttcacgagtggtaataaattcaataccgtgagccgctaaggtttcgctcacaacacgttgtgcattgcttttgccagctccttctaatccttcaataacaataaattttccacgcattatttgttctcactctttttatttcgctcaatttggatccattctcgtaccgctttattatgctcatctaaggtacgactaaatttatgtccgcccgaaccgtccgccacaaaatagaaataaggcgtactgtcaggctgtgccgtcgccttaattgacgcttcgctcggcattgcaatcggtgtcggcggtaaaccatcaatcacataagtattataaggcgtaggttcaagcagatctttcttacggatattgccatcatatttatcgcccataccgtaaatgaccgttggatcggtctgcaatttccagccatttttcaagcgattgataaacaccgatgccacttgcggacgctcatttgccacacctgtttctttttcgacaattgaagccaaaatcagcatttcataaggcgttttaagcggtaggttttctgccctattttgccaagcttgtgccaacgcctttttctgtttttgataagcacgtttaagcacatcaatatctttggaataaggcacatagctataagtatcaggggcaagccaaccttccagtttatcttgagcgatccccaataattgagctatatcagcttccgttttatccgtcaaggtttgctccaaatgacgagcctttgccaactgttcacgccacgttttaaaggtttttccttcaataaattgcacatttagctgcacttctttgccactgttgaaatgttgcaacaacgctttcaccgtagtgatattctctaaagcataaaccccagccttaaaattactgagttcagggtgaagacgaatcaagtagggtaataaatccacatcatcatggctaataatgccttgttcatccaactgacttgctagtttttggcttgatgtacctttttccaacacaaacagttgctcaggtttaacggttaatttatgttctgctaactgattgagtttttggtaaacataaacgccaccacctagggcaaccgcagataaaagcccgagagaaataagaattttttttaacatggttaggaatatcgatcaaaagaaaaacgaaacgaaccttactataagggatagtaaaaagctatgacaagcggtaagatttttttaaatttttacaaaattggaagtgtaaatggtgggtcgtgaaggattcgaaccttcgaccaacggattaaaagtccgctgctctaccgactgagctaacgacccgtttgggaattgagttctaaagtggtgggtcgtgaaggattcgaaccttcgaccaacggattaaaagtccgctgctctaccgactgagctaacgaccctttagaaaggtacgctgattaagtggtgggtcgtgaaggattcgaaccttcgaccaacggattaaaagtccgctgctctaccgactgagctaacgacccataatcttgcgtaacgagggcgtatcatacggattttacgtttgagatcaaccctttttttatatttttaacttatttgcatagtttacaagcaaaaagtataacaaacggtaagattttgcaaaaaatttaccagatcttaccgcttatctctgtgagaaaaattacgctttcgctttttcagctgcttttacaatcactgcaaatgcaggtgctttaagtgacgcgccgcctactaacgcaccatcaatgtctggttgagtaaataattcagctgcattcgcatcatttactgaaccgccgtattgaatgatcacttgatctgccacggcttgtgattgttttgcaatgtgactacgaatgaaagcgtgaactgcttgcgcttgtgctggggttgcagatttacctgtaccgattgcccaaactggttcataagcaattactgcaccattgaatgcttctgcacctaaagtatttaatactgcatctaattgacgggcacatactgcttcggtttgaccagcttcgttttctgtttcagtttcaccaatacataacactggcactaaacctgcttcttttaatgctgcaaattttttcgcaataaattcatcgctctctttgtggtaagtacgacgctcagagtgaccgataatgatatatttcgcaccgaaatcttttagcattgctgttgaaatatcccctgtaaatgcaccttgtacattcacatcaacgttttgagcgcctaatgcaatgagtttattcgtggtgcattcacagccacagctcgctaatgccgcttctgcttctgccaaatacattactggcggtgcgattgcgacatcacaatctgtaacaccatcaagttctctttttaaactttccactaattctttagtgaatgctttgctaccgtttaatttccagttacccattactaacggacgacgtgccattttgtttctcctattgagtgaaatgtaaaataaaaacgtgcgaactataccaaatttcacagaaaatttattgtttttccgcaagatttcagctcaatatttaaaaataactgttaaaatagccattaagtaacgataaggcactttctcgtgccttttttaataggaaaaacaatgcaattagcgtatttattcggcaaaccgacccaagcgggtcgattgaaagtagaatctgccgattttattgtcaaagaagaacttggctatgatttgtcaggcgatggggaatttgtggcggtaaagattcgtaaaaccgatgcaaataccttgtttgtgggcgaaaagttggcagaatttgttggtatttctgctaaaaatatgagttatgctgggttaaaagatcgccacgcagtcacagaacagtggttctgtttacatttagcaggcaaagaaacgcctgatttcacacagtttcaattcgatggcgtagaaatcattgaagtcactcgccataaccgaaaaattcgggtaggaagtttggctggcaatcattttgagctattgctaagagatgtaaaagagagcaatgatctcaccgctcgtttacaacaaatacaagcggttgggtttccgaattattttaccgaacagcgttttggtcgagatgggcacaatttaactcaagcacagcgttgggcgaaaggcgaaatttcagttaaagatcgcaaaaaacgcagtttttatctttctgccgctcgtagtgaaattttcaatcttgtggtgtcgaaccgtattgaactcggtttaacccagcaagtgttggaaaatgatttaatgcaactggcaggttcaaacagctggtttgtagcgaaagcggaagaacttgcggcacttaacaagcggttggaattgcaagatattttacttactgcaccgcttgtcggcgaaaactctgccacacaaatagtgtctgagtatgagcaaaaaattgtagtggaacatcaagatctactggcattaatggcaaaagaacgaatgaactcagctcgccgtgcgatgttctgtaaaccacaacactttgaatggctatttgaagaggaaggtttacggttgaaattctttttagatgctggcagttatgctacggcgttggtgagagaattagtacagctcgaagaataactaaactttccccctttgaaaaagggggatttaaagatccagatattttaccgtactatttaaaatcgcccctagcccccctttttcaaaggggggaattacaactataaggaaataaatcacaatgaatatactattaagcaatgacgatggctttcacgcccacggtattcaatttttagcgaaagcattaagagaagcaggacataaagtaaccattgttgcccctgatcgcaatcgcagtgcggcatcaagctgtttaacactggttgatccgcttcgtgtgcataaatttgagaatggtgattatacggtgattgcaggtacgcctgccgattgtgttcatcttgcgttaaatggtttacttgatgagccgtttgacttggtggtatcagggattaatcacggggcaaatttaggtgatgatgtggtctattcgggaaccgttgctgcggctcttgaaggtcgtcacttaccgttgccatcagtggcggtgtctttagtgggttctcacggttcaacctatttaacaggcaaatgccatttcgatacggctgcacaagtggtggttgaactattgccgaaaatcacggcaaatcttattcctgcaaatcaagtgttgaatgtgaatgtgccaaatgttccttatcacgagttgcaaggtattcaaattactcggttaggcgatcgttctcctgcggctgagattattaagcaacaagatccgcgtggggcaaatgtgtattggattggggctagtggcaagccaaccgatgaaagcgagggtaccgatttttatgcaatcaaccataactttgtgtctatcacccctattcaaccagatatgactgcacatttgtcgatttcacgtttaaatgaggctttttaaatgaaactttttggaacaatttatgataaaacgatggaatggtcaaaacatcgctttgctgcaggttggttgagctttgtgagttttattgaagcgattttcttccctattccgcctgatgtaatacttattcctatgtcgatgagtaaaccaaagatggcgacacgttatgcgatttacgctaccgtttcttctattattgggggaattattggttattgtgttggctattttgcgtcagattgggtacaagaagtggttgctaactggggaatgcaggcaaattttgatcgtgcaatgagctggtttgaaatttggggaattatgattattttcctcgccgctggtttttcacctgtgccatttaaggtatttaccctttgtgcaggtgtattgcagatgtcttttttaccctttattttgaccgcttcaatttctcgttttattcgttttctacttgtggcaaaattatctgcgtggggcggtgagaaatacgccgataagatccgtcgttcaatagaattaattggttggggaacagtgtctattgccgttgctgcctatgttatttataccttattaaaataagaggctattatgaaaaaatcgtttcttttacttccgcttgcagcagtagtgttagctgcgtgttcatcagatacatcgtcagaaacctcgcctaatgttgaagtgacagaggttggatctgcgtggcaaaccgaagttcaacaagtgggtatgccaagctcaatgacacagccaacttatcagcctcaaccaacttatactccgccaccagcaccgcagccgacctatcagcctgcaccacaaccgacttatagccaaccaagcaatgttcaaacgaactacggcggtcaaagtgaagtggtgggaagttgtaatgtggtaagagatggaagtaatgctccgatttatagtcaaattcagaaaggttgctatacagacagcacttataccgttggcaaacacgatacgctctttttagtagcttatttgacagggcaaacacctaaccaaattgctgctttaaataatttgagtacagcaacgccattgaaagtaggtcaagtacttagagtaaaatagttttatttgtaatgacatttgaatggacgcaggggttgcgtccattacgatattgagcagacgctgtagcgttttagacttttttaaacgccctttggcgttttcgttttctttgaaggataattgaatgaaaaaatcgtttttcttattaccgcttgcagcattagttttgactgcctgcggttcaaatacgcctgcacctgtggtaaatgcggaaggttctgatttatcacctggcgtaatgcaacctattggtatgggggcaaacaatactaattacggctggcagacagatgtgcaaagcacttctatgccaagcacgatgacacaaccaacttatacaccaccgccagtgcctcagcctgtgtatcaagctccgcagccaacttatcaagcacctcaacctgtgcctcaagttgttcctcagccgataacaaagccgacagctaaaacaacacccgtagcgaaaaagcctgtatcacaagattttactattcctcgtgatgccaacaatgcacctatttatagtcaaattgataaaggcttctataatggcgacagctacactgtccgcaaaggcgatacaatgttcctcatcgcatacattgcaggtaaagatgttaaggaagtcgctgctttgaacaatatgagcgagccttatcaacttcatgtagggcaggttttaaaattgggtaatactcaacctgttgaatcaaaacaacaaactgttcagtcaccaaaacctgtaccaacaccagtagaacctgtagtaacttatactcaagcaccgaacggcactgcttatggctcagatggtacaatgactggtcctgtgaaagcgagtgtaggcactgttccacctgctcaaacttctacaaccccaagagtaacggcaactgcggctaacaataccccgaactacagctcaacatctgcaccagcagtggcatcgtcaattcgctggcagtggccgacgcaagggcgtgtaatttctggtttctctgcatctgaagggggcaataaaggtttagatattgcaggaacgaaagggcaaccagtaaaagcggctgcggcaggtcgagtagtttatgcaggtaacgcactacaaggttacggcaacttaattatcatcaaacataatgatgacttcttgagtgcctatgctcacaacgacagtatcaaagtggaagaacaagataatgttaaggctggtgaaaccattgcgactttaggtagcacagggacaaacagcaacaaactgcatttcgagatccgctatcaaggtaagtcggtagatcctgctcgctacttgccaagacagtaattatgataatttgatatttagtagataaagaaaaaattactttgggaaaggcgcaatgttagcgcctattcaattttaggtctatgatgatcaagatataacttattcgtaactatccttactacaaataattttaattataagaatatctataatgatttaaacggatatcccccaaaggcttttgcaatccccaccaccacatttgtcgcctgttccattacatcaacagaaataaactcgaaacgtccgtggaagttttcgccgcctgtaaaaatatttggcgttggtaagcccatatatgataggcgtgagccatcggtaccgccacgaattggctctaggtttggcgtaataccctgtgctttcatcacattttcagcaatatccaccagatagcgataatctttgactacttcgtacatattgcgatattgctcgacaatctcgactttgccgcactgttcgccatatttttgttgcatttgtgccattgtagcggtgagataagtgccgaattttgctaattcttcacgctcaaaactgcgtaaaatatagtggattttacattcgcttaaatcgccttcaatgtcgtgcaacataataaagccttcacgcccttcgctggttgcaggggttaaatgtggcggtaggctgttttggaactcacaagctcgctctaaggcattgatcatcttgcctttggctgtgcctgggtgaacactgcgtccgtagaacgtaacagttgccgcatcggcattaaagttttcgttctgtaattccccaagcggtccgccgtctaaggtataggcaacatctgccccaaaggctttgacatcaaaatgatccgctccacgcccgatttcttcgtcggtagtaaaaccgatacggatcttaccgtgtttgatttcagggtgtgctaacaagtattctaccgctgacagaataatcgcaatcccagatttatcatctgcaccaagcaaagttgtgccgtcggtggtcacgagcgtatgtccgactaagccgtttaggttcgggaaatcctgtggcgatagcgtatgcccactgccttttagcaaaatatcaccgccttgataccgctcaataacctgtggcttcacattctcgccgttgaaatcaggggaggtatcaacgtgagccagtaaaccgagtgcgggaatggctttgtcgctattggcaggcaatgttgcaaacacatagccgttaggatcaacggaaatctcggttaatcccatcgtttccatttcggttttgagtagatgaagtaaatcccactgttgcggtgagctagggacagtttggcttttcggatctgatgtggtgtggatttgaacgtaacgcaataggcgttcaaaaagttttttcttaagtagaaacaaaaatgacctcccttatacaatgacagtaatatattaaaatttttatatcacgaaattttaactcaaccacagataaacttaagctaatttttaagaaaatgactatttattttcctcttcaaatccgccactttctgtgaacgataaatcgcattgattgcgtggattaaagctcttgctgaagattccacaatatctgtcgctaaaccaaccccatggaaacggcgaccttgatattctacgacaatatcaacctgtcctaatgcttcagcaccttcgcctttagcggttaagttatagttgagcattttaatttccatacctgtaatcgctaaaatagcattataaaccgcatcaacaggaccattaccgccttgtgaaacttggcttacacgtttaccatctaactcaacttgcacaaaggctgaagctggcaatccactaataatttgtgtggtaaatacatcaagggctaaacgatcttcatcgccttgttgcatatcaataaatgcaagcgcttccaagtcataatcaaaaacttgaccctttttatccgctagttttaagaaagcttcataaagtttgtctaaatcgtaatcgctctcttgatagcccatttcttccatatggtttttcactgcagcacgaccagaacgagcggtcagattgagcttctcttttttcaatccgatagtttcaggcgacataatctcataggtatttttatttttaaccataccgtcttggtggatacccgatgagtgagcaaaagcatttgaccccacaatcgctttattcggttgaattggcatattacaaagttggcttaccatttggctgacacggtgaatttcttgggtattgatacgagtatctaagccgttaaataaggcttggcgagttttaattgccattaccacttcttcaagtgctgtgttacctgcacgttcaccgataccgttgatagtgcactcaatctgtcttgcaccattttgaattgcggttaatgagtttgcagttgccattcctaaatcgttatggcaatggacagaaatcactgctttatccacatttggtacacggttcatcacattagcaatgatgtttccgtattccattggtaagcagtaacctacggtatcaggaatattgactgtggttgcccctgctttgatcgctgcttcaacaatacggcagatattatctacccctgtgcgtcctgcatcctcgcaagaaaattctacatcatcggtatagcttcttgctcgttttacagcgtgaactgccatatctaatacatcgtcaaaggttttacgaagtttagactcaacgtgcaaagcggaagtggctataaatgtatgaatacgaaatgcttcagcaacctttaaggcttctgctgcgacatcaatatctttatcaaccgcacgagataaagcacatactcgactatttttaatatggcgagcaatggtttgaacagattcaaaatcgccagcagatgacacagggaaaccaacttccattacatctacccctaaacgttcaagagcaagtgcgatttgcaatttttcttttaccgttaaacttgcttttaatgattgttcgccatcacgcaaagtggtatcaaaaataataatgttgttgctcatataaagtacctcttaaaatgtattcgataaaaaaagcccgcattttgacgtgcgggctaaatgtggatagtgaacttttctctaaccgagcctcatcctcgcacagaatgcgtgaatcccagcaggttaagagttaaaggttttatcatagttgtgtgtttatgtttgcattgttattcagaaattgaacatatattaacttcaaatggagtaatgtcaatagcattttatacttggcgcaaacgttttctgtgtatttttaggtaattaaaatagttaaatatgctaaaaaatttagactaactagtgattaatataaacccttgtaatgtataacgcataaatatcattttttttcagcaaaaaatgatgtttagtattttttatattattttgctattttttaaccgtagcttaatcacaaacaaaaaatgtatgctttcttttgcgatgataaaataaatttgttaggcttaactaccatttcaaaatgataaaggaatttctatgaccttaccttttcgtgcaattatttctgatcttgatggcacattacttaatgcaaatcaccgcattggcgattttactatcgaaacattacgcaaactttcacaacgtggtgtcgatatttttctagctacaggcagaaattaccctgatgttaaacatattattagtaaagttggcgtgagtgatgcaatgctagttacatctaatggagcaagaggaaataacctttctggcgaattgctttatcaaaatcatattcctgaagagattgcttttaagataatgagcgaaacaccctttgatcctaagcgagtcttcattaatagctatcaaggcgatggatggttcattaatattgaaatcgaacaattacgaaaatatcaccaagactctggctttatgtatcaagtggtagattttcagcaacatcacggtaaaaaaactgaaaaagtgttctttattggaaaaacgcctgaagacttgttacctgtcgagcaatttgtacgacatcattatggtgatttactacaaattacttattctacctctcaatgccttgaaatgatgaataaaggcgtttgtaaagcaaatacacttgcagacttagtcaagttacgaggctataccttgaaagattgtattgcttttggcgatggaatgaatgatattgaaatgctatcccaagcaggaaaaggctgtctaatgggtaatgcagatcctcgtttaaaacaggctttaccaaataatgagcaaattggtgaaaataaagatgaggcagtagctcaatatcttagacaattatttcagctagataaaatatgtaattcaagagcgtggaattgaacaaatcttattttgtaaaattagagcatcatttacattttcgttataagcatatgcagttcgctttgaaacgtttggaaagttggcggcaaatagtgtttctattgttacgctattaagtacagtaactatctcgtccgtattatttggcttagtcagtgcagataaaccagcattgtttagaacggcaatggaaattcacgataaaattcgagagatgagagaaattaatcaatggtttaaagaagatatggcgaaaaaattagtgatgtaaacaaatgagtatgcctaaattgaatatggtgaaaccaatttggtcattgaaaaattagaacaaagacagagtaaaatttattcttcgtaaaatgcaaaatttatctcaccgcttataaaccaagatcttggttttcaaatgatttgactcgtgcaaaaagcagagtaccatttcattatcttattatttaaaggatttccctgtgcaatttttttcaattatacgtattgttggcattttggtgatgtgtttttctttcacgatgcttgtgccagcgtttgtggcgttgatttatgatgacggcggtggtcgtgcgtttttggaggcctttgtgctgaatttcagtgtcggtacggctttgtggtggttttgtcgaaaatataagcaagagctacgttcccgtgaaggttttctaatcgtggtgctgttttgggtggtgctagggtcgctgggggcggtgccatttattctgttggaaaaccctgatttgaatttctctgagtctatttttgagtctttttcaggtttaacaacaacaggggcaacggtaattacagggctagatcagctgccaaaagcgattttattttatcgtcagttcctacaatggctcggcggaatggggatcatcgtgcttgcggtagccattattccgttattaggcattgggggaatgcagttataccgtgcggaaatgcctggtccgttgaaagaacagaaaatgcgtccacggattgcagaaacggcaaaagcattgtggctgatttatctctctttgacggtgctgtgtgccgttgcttactggttggcaggtatgaacggttttgatgcaatttcccatagttttgccacggtggcaattggcggattttcaacccacgatgcaagtatcggctactttaacagtccaacgattgatttgattacagtgctgttcttattgatctcttcctgtaacttcgctctgcattttgcggtgtttgatcagtttaatgatcgctacaaaggcaataataagtcgaattttcttggtttgtattggaaagattacgaattccgcttttttattacggttcagttagcgttatttgtgatctgttttggagtgttgctgatttataactattttgacgatcactctgtgacctttattcaagccttgttccagtcggtctctatttcgactacggcaggcttcactacgaatgattttagccagtggccgtctttcttgccgttgttattagtgcttgcttcctttattggtggctgtgcaggttcaacgggcggcggtttgaaaatgttccgtgtgttgttgctttatttgcaaggaaaacgagaaatccaccgctttattcacccaaatgttattcagccgatcaaattgggtaaacacgttttatcagagcggattgtggaaggggtatgggcattcttttcagcctatttctttgtatttgtggtctgttggctggcgactattgcttgtggtatggaaactttcgatgcattaaatgcggtgattgccagcctaaataaccttggaccagcattaggcacggtcagcagtaactttactcaaattcctgatagtgcaaaatgggtattaacgtttgcaatggtttgtgggcgtttggaagtgtttaccttgttggttattctcagcccgagcttttggatagattaagagattagtagtatcctcctttattagattttatttactattatacccactaaacagaagcggtgagaatattgtattttttacaactttctcaccgctttcatattacctaattaaagcgaattaacaaaaatcacaataatcagtacaggaataacataacggacgtagctaaaccaaatgtttgtgaatttttcactagtatttaactctttcttcgcctcatctttcaatacatagccgacgaaaatcgcaccacctaatgcggttaaaacgaagagaatgttaccgcttatgtagtcgaacgcatcaaaaatgctcatacctgcaattttgacattgctccaaacgttatcgccaagcactgatgggatattacccacaatgaagataccgagtaatgtcaaggtgatcgcttgtttacggctcagtttagttttttcttgcaatgcggtaatcaaaacttcatagatggtaattgatgtagtgagtgccgcagtgattaataaaccaaagaagataatcgcaaagattgtacctgcccacatatgtgagaacacaatcggtaagctttggaacactaatgttggtcctgagttcggggcaacattaaaggtaaagagtgatgggaaaatcataaagccagcagcaagggcaattaaggtattaataacccctgtaattgttgcggttttgactagattttcttgtttagacaagtagcttgataaggtaattaataccccaaaaccaagactgagtgcgaagaacacttgtcctaatacgaagacaaagagcttcggtgtaatttttgagaaatctgggataaggtagaaactgataccttcggtcgcaccaggtaaggtgacattacgaataatcataatgattaagaagacaaagagtagtggcatcagtagttttacagaacgctcgatcccctctttaatacctctaatcaggataaagtagtttactgcaacaaaaactcccgtataaagaataactcttaatggattgttttgaatgttatctttaaagtaggcagatgtggtttcaattgtgactggcgaagagagatctaagccgcctgttgctaaactaccgatataggtgagtacccaaccgcctaataccatatagtaggctaagataccgacagaacccagtagccccatatagccgagaattttccacgcagaatggatttttttgccattcgcactgccaccgaaggcatcaatggaattgacttgcatacgacgaccgatcacattttcaactaaaatcatcggaataccgattacaatcatcgcaatacagaaaaggaaaacataagcaccaccgccgttttcccctacaagataagggaaacgccaagtcgcaccgaaaccgactgttgcccctgcgacagttaaaatataggttaattgactagaccaagactgccgttcaggttttgtattttcactcatagtacacctcttttaaaaatagcagagagtaggctcagtcaagctaacacaaccgctaatttgatattgatttagggaaaaccctaaatggtggataggagagatccccctgattattcagggggaacgttcttgatcaatacaacacagcttgatattaatttaaggggctgtcctagataactaacttaaaccacccttaactaattgttttaaaatggaaatttgagattttaagttaccgtgattaaaacgccattcgcattccttcaaatacaactcaaaatgtgctttgggaataccgttaaacttgcgtaaatgatgtttagcttggttccaaaaattctcaattccgtttatatgattttgtttttctgcgaaatgagtactgtgattgatacgaaaatgattaaactcactcacatcaagaacatcatagcttcgataaaaatcgttgtaaacaatgctgtcaggcttcaccttttctcgaataatcggtaaagtgtcgcagattgaatattcggtacaacgacggtatacaccttaccatcacactttaaaagcccgaatacagcggttttacccacagctccacgacctcgtttacctttgcgagtggtgccgccaaaatagctttcatcggcttcaatttcaccttcaaacatctccatatgtggactgttttgatagataagcaatcgcagacgatagaagtaatgggctgctgtcgttttatttacatttaccaactcagccgctgttcgagcagtgacacctgccacaaacagctcaatgagtttattttgtttatgctgacttagacgactttttctcatttggttattttaacctaaaatagagcttttagtcgttatctaggacagctcccctaaatttattgattcctaacgcccctaaaaaccctaccgcttgcaacaacacaatacaaggtcctgtggcgacatcaaaatggaaacttaaaaacacgccccagaaagcactatttaccgcagtaaagatggcgatcagcagcattcggtcaaagcgtttggcaagtgtgtagcctgtgatccctggggtaatcaacattgcgaccactaaaatcacgccaactacttgcattgcactaatgatcactaatgccaataaaaccagtaagctgtaatgtaacactttgatattaaagccaacggtgcgagtgtggctggcatcgaagcagtatagtaggaaatctcggcgtttcactaagataactaataacaccacaagagagatagctagggtttggtaaaattcactgttggtaatcccaagtaggtcaccaaataagatgtgcattaaatgttgatcggtttcaactttggcaaacatcactaagcctaacgcaaacattcctgaaaagacgatccccattaccgtatcttctttaatgcgactattttctttgagatagcccacggcaacggcacaaaaaatacccgaaacaaaagccccgattgctaatggaatggcaagcagataggcaatcacaatccctggtaatacggcgtgtgagatggcatcgcccattagcgaccagccttttagcactaagtagcaggacaacacagcacagattatggcaaccacaataccgataactaaggcttgttgtataaaagggaaagcgagcggttcagcaaaccattgatagagcgcgtccattattcacccccttgactagcggtcggtttggttggattttttgcaaatttgcgtgaaactaaaccatatttaggggcaaagaagaacgctaataaaaacagtagggtttgtagcgtgacaataaatccacctgtcgcaccatcagcaaaatagcttagataagccccgaaaaatccactaaaaccgccaagtgaaattgcgataatcaataatttgccgaatttatccgttaataaatacgccgttgcccctggggtgacaaccattgcgatcactaaaattgcaccgacactttgtaatgctgcaacgatacaagcactgagtaggctaaaaaacagtactttaagtcgcatcggcgaaatgcctacggctttggcttgaatttcatcaaaaaagacaagcaataaatctttccagtaaattactagaaaaaagagtgacaccgataaaataatcactacttgtagcatatcttcatcggcaatgcctaagatattgccgagaatgatggattgcacattaacggacgttggattgattgaaataatcaataaacctagggcaaaaaaggtggtaaaaataaagccaattaccgcatcttctcgtaattttgtgacggatttaaccgctaagatagcaatagtggcaagaaatcccgaaaagaaagccccgacagcataaggcaaggacaaggcataagcaaatgctacaccaggaacaacggcgtgcgataaggcatctccaatcagcgaccagcccttgagcattaaataggcagataaaaaagcacaaaccgccccgattgcaccgcttaccacaatcgctttaaacatataatcgtaggaaaaaggttctagcagtaactcaagcattgattattccttatgttctccgagtaactgctgataacgcaagacaccgccaaacactcgctcaagattttcaggggtgaatgttgtttcaattgttcctgttgctaacaccgtgcgattaatcattaccgcttgatcgcaaaaacttggtacggcagctaaattatgggtagaaacaaggattaagtgaccgctatcccgaagctgtttgagcagatcgatgatcgcattttcagtatttacgtccacgccagtgaaaggttcgtcaagtaagataattttgctctcttgagcaagcgaacgtgccaaaaacacgcgttttttctgtcccccagaaagctcgccgatttgacgatcagcaaggtgagcaatattgacccgatccattgctgcggcaactttttgcttatccacagcagaagggatacgcagaaaattcatatagccataacgccccatcattactacatcataaaccgatacaggaaattgccagtccacttcttcactttgtggcacataagcaacaagattgcgttttaaggcttgattgacaggcagtccgcatagttcaatctttccttttggctgaactaagcccataatgcttttaaataaggttgatttgccactgccgttcaccccaagtaatgcacagattgtgccaccgtcaaggcgaaaagtaacatcgtgaattgccgtgtgtccgttgctataacgaacggtgacatcagaaacagaaagagaactcagaggaatgttcatatttgttaggtaatcctacataataataactataacatattgatttaaattaaatttccctctcccatttatgggagagggtggagaaaatccgtaggattttcggaggaagagggcaaaatagccctctctctgcctacggattctgaacgaatccttcggctgtctctctcccgtaaacgggagagaggaatgatttatttctcaaatccagcaacaatagtacttacagtgacattgagtaaatcaatataggttggtactttgccatctttggttgagagagagtccacatataacacaccgccatagcgtgctttactctcttttgccacttgtttagctggtttatctgaaatggtactttcgctaaataccactggaatttgatgtttacgcacttggtcgatcactttgcggatctgttttggcgtgccttgttcatcttggttaatcgcccaaagatataactctctgaagccataatctctagcaagatagctaaacgccccttcgcttgtcactaaccaacgttgtgcttcaggcacttttgccaagcgctcacgcaacggctgatctaaggcaacgatcttatcggcataggcttttgcattcgcattataggcttctgcatttgctggatcgtattttactaaggcttgacgaatattctcaatataaatcaaggcatttttcgtagacatccaagcgtgtgggtttggcttatctttgtaaggtccttcgtagattgaaattggctcaatgccttccgttaccacaaccgcaggcttatctttcacctgagcaaagaaacgctcaaaccaactttcaaggttcataccattccacaacaccaaatccgcagattgtgctttcacaatatcctgtggcgttggttgataatcgtggatttccgcacctggtttggtgatcgattcgaccaccgccttatcccctgcgacattttgagcaatgtcttgaatcacagtgaatgtggtgaccactttaaactgctgggcagcaagtggattactgacaaaaaagagcataccaagtagtgctgctaattttttcatagttagactccttatataaattatgggttttcgggagacattgtatagataaaaattaacctgtcaataaataaaaatgattctcaacaacctcaactagatgataatcaacaaggcgatgaagatgataatcaataagcgttaaaaatgagaacgggttgctatttttatctagcaacccgttgattttattactctttcctaaaatgccgctgacttttgctttcttggcggctttctaagagtctgtgatagttatcaaaacgtatcaaggagattttcccctgctctacggcttcccgtaatgcacaacctgggtcatctttatgtttgcaatcacggaatttacaagtgcctaataccgaagcaaactctcgataaccttgtgtaatctgatcggcttctaaatgccataagccaaattcacgaatccccggcgagtcgattaaatttcctccttgagataagtggtataaacgtgaagccgttgtggtatgttgccctaagcctgaaatatcgctgaccgcccccgtttgggcattcacatcgggtaataactgattgattaggctcgattttccaacacctgactgcccgacaaaaatagaggtgcctttcgctaaataagcattcaaagcttccatattctcgcccgtatccgccgataaacagaacgtctggtagccgatcttttcatagatcgcaagctgttgttgtacttcttttcgctcttgctcactcagtaaatcaattttattcaacacaattaatgcaggaatgttggcattttcacaaatcactaaatagcggtcgataatgttcagagagagctgtggcaataccgctgacacaatgataatttgatcgatattcgacgccattactttaataccgtcgtaatagtcagggcgagttagttcattttggcgaaggtgaacaacctcaatcacaccgctaatcccttgtaactgctcacttcctaaacgccacgacaccacatcgcccaccactacatttttcagcgttcgacgtaaattacaacggaaaatctcaccgcttgctgtttctacatcggcgtgtttagcgtggcgagtaaccacaagaccttgctggacttcccccaacatttcatcttgccattcaaattcagctttgttgatctttttgtgatggttagtttgaatccgacgttgttgattctgagttaagcgacgtttgctcaaaagattgacctgactttactaaaaaaataaccgagagctgaccataaaaatgggagctagacgcttccatttttatgtatacctcaattatcttgcacggaaaataattcgccccttacttaaatcgtatggggtcatttcaacggtgactttatctccagttagaatccgaatatagtttttacgcatttttcctgatatatgggctgttacaacatgcccattttctagttctactcgaaacatagtattaggtaaggtttctaaaattgtaccttgcatttcaatgcaatcttctttagccatttattcctcttcaaattaaatttaagttgtgtcattgtaaatatgccatattggcaaaatgcgaggtattatactctcccttacctgaattacaatcatttacggcgaaaagctcttcttcgagagtgaaaacgttgagtttgacgtttcaattcaataggtataaagtttgacgaaactgtttttgttgtatttagctgtaaaaaataatagaaacaactaacaaatagccctccagacataaataaaataatcaactcaccataaagcaaatgaaataattcatttactttatgttgtgttgtttgcccatattgagagtcaaaagttactcgtaaaaacccaattaagtcatcctgtgcaaaaataggctctacaatttgttgggtaagtaccggctcttgttgtatcttgtcgtttactctcgggttaaattcaatcgcattgctactatgtgcaactaaatttcctgatggcgaatacaaattagcatcaatgacaaacgcttctttagcaaaaacatctaatgcttcaactaattcatcattttttgcgttttttactaacatcaaggaaaacaattttgcctgttgtcgtacaagtaaatgagaaagatttgttacttggttaatcccagccagctgtgaacctactttgaaatggtttataccggtcagtattatccacacaatcattaaacaaattgctatgatcacagcaataatgctactctttattagttgttcacgagaaatatacataattgtccccataaaattagaagatgattctaacacgtaattttgttaaagttagtaaaactcactataaaggtttggaagaatcatgtcacatatcttttttatttacagtaagcagcttacagctgaacagattgcccacttcactcacataagttctactatttttgtaaaacaagtggagtatttggattaccatgttgctttttttagaggagatttgacagattctctacgagagaaggctcaaaccatacaagctgattttagtaggttagatattcttccttgcattaaaaaagaaggtttacttttaatggatatggattctactgcgattaaaattgagtgtattgatgagattgctaaattagcaggaaaaggagagattgtttcatctattacagcaagagctatgcgtggagaacttgattttgaagaaagtttacgtcagcgtgttgcagcacttgaaaatgcaccagaaagtatcttacaacaagttcgtgaacagttaccacttatggatggttttgaattattagttaaaagtctgaaacaatatggctggaagatagctattgcttcaggaggatttgactattttgcagactacctcagacagtcttttgatctagattattctgtgtcaaataggcttgaagttattgatggcaaactaacaggtcaaatacttggcaaagtagtagatgctcaatgtaaagcagatacgttaatggctctagctcacaagtttggtattccacaagtgcaatggattgcagtaggagatggagccaatgatctactgatgcttaaacatgccagtttaggcgttgcactacatgccaaacccaaagtacaagaacaatcggcattcgtagtaaactttggagatttaactgccctactgttactattaaaagcaaaggaattgtttgattccccataatgtctttagatatatatctatatttcttttgtctattacacccaataatcaattaagacaccaatatggcatagtaacttttgtttactatgcctcttaatatcagattacttcaacaaatcttcatttttagcgtgattccatttaccacgctttttatccatatactgaaaatattcgttagtaaaagtcccctgcgcacaagtgattttatctcggcgacgattaaccgtttttccttccaatgccatatttaaggtggctggcccagttaaagaaaatacgccaccatcaatccgacgttgctcaatattatcgacaataatctctaacgtttctttcaaaaacgcatttcccttttcactggctaaaaagaaattggtgtattcgtctcggcgagtgatcaaaacctcactatcattttcaccaataattgaagacagattccaaactaaatgtccatcaatatccatatagataccgccttcattatatagggtgaaaatacgccaaaaatctgcctgcgcagccccatccgtcagtttactatacgcattaaaagtacgctcatctgcattagctttgatatactctgcccgctcttcagtgctaacataacggtagtcataatctcgtgacaacaaacgattaaccaaataattacaatacactggtaaggttactttgttgctgtaattagtctgccaaatgaccttagtaattttcgttgatttagctgatacgcttttagctggactaaattctggaatggtaaaacgctttttcggaaataaggcgtgaaacgtatagcttaacgttttgacgatattccctaataaacgccataaaccattagcaattacaataaacatttcatttttgactggtctgttcatattagctccttttggatagaaactcgtattaacattttatcgatattgaaaaaagcaagcgagcagattttgcgataaatttgcaagctctgcccgcttgtgaggggttaagcaatcgtcatttgcccggcataaagaacaaagtaacgtaaacagagaacaccgattaaacctaataccgcaagaaaaaggataaagcctttttggtgtttgacattagctggtgaaacaatgttaagtaacattggaatgactaaaccgatagccacaacgcctacccagaacattttaccccagtagcctgagaaggctaaagcgttatctgctgccacagcactttgtccacctttagcataaaggtaagcaaagaagcctgctaaaagtaacatttcaataagggcaactggtttttcaaacttgtgcaagaaatgtacttcgtgactatccgttgcgactttgccaaccaccaagattacaacaagaagtgctgcaataccagatgaagttcctgaagccaagaataagactggcaagacagggttatttaacattgggtaactgattaattcagataataagaaccccgtataagccccaagtgcaagggatagtaagatcaacaggatttcaatcaacgaggtaaattttgccgcaatatcaatcaaaccaaaggcaaatttcggaataaaaccaaaaccgcttagccagtttttgaagatgattgccagccaaacgactaataccgccataaagacttggaatagcattacccccatcgacattaccgaatcaaactggtagttaaacatcaaataccagaatgtccacggacgagccaagtggaaaatcaataaggttaaaccgatgattgttgcaagcggtgacattattgccattgtgcgaatcatccaactctggcttggatcagctaaactcgctttacgcttatatagcacggctaataaagttgaacctgcggatatcccaagtaaaaagagatagatcgcaatggtcgaatcccatacaagatttggggtttggaatggaacatagtcgttcattattttgcctcccttttcttaatatggtaaagatttggttctgtgcctaattccatttttgtgcgataagttggtttttctttgattaaacgagaaatatcgctattcggatcgtttaagtcgccgaatgttaatgctttggttggacagctttctacacaagcaggctgtttaccttgtgcaagatttgtatctcgacagaagttacatttatcggcagttttcttcactggctcaatatagcgaacacgatatggacagaccgcaatgcaataagcacaaccaacacagagatctggattaacatcaacgatgcctgttgctttatcaatgaaagacgcacctgttgggcaaacactcacacaaggtgcattgctacaatgttggcaagattgacggaaaaattcatattttacgtttggaaattcgccataaggttggctacgaataatttctaaacgggataccccttctggcactttgtttgtttcacgacaagcgtccatgcaagcagtacaaccgatacaggcttgttcatcgtgcaacatcgcatagcgaatggttttactttctttctcagtcgcaagggagagctgacttgtggcaagccccgttgtgcctgccacggcaatcactgctcccgcccctgagatgaaatctcgacgggaacaactcatttttgatccttagcttccgcttttttaaacgtacctttgtgtacttctgtgtgacaatccacgcagagttttacacgctgtttagactcaatgcctttcattggctctttttctgggtgtagtttgtggcagtttacacacgcaattttattagcgtgagtgtcgtgcgcccaaaatttttcacgcaatttgtcagggctatggcaagcaaaacagacttgattttgctcttcaactgaacgctctagggctggatttttagccttaccgtgagcattaaaacgcattacgtctttcacacccttacggtgattttcagaaatattgccgtgacaacttacacagttaagcggtttgccgttattcggactaaccgtgtctttttgaaagtgcttacctgtgtgtttgaaggtagataaatgtccgtgacaattcacacaataagtattcggatcacgacgagagtctttagcaatagttgcaccatctacattgtccaacggattgctccaaattggttgtggctgtgctggcatttctgccaacacagtagaagatattgcaaagaaactcagtaatgcaaccgcttgtagcttaatcattgagaaaatatgtttcatagtagcctcgacttagcaaattattttgcgtccgcaggtaataagcctttctctttcgcttctttttcccattgtggtactacggtgcgtaagaattcttctttcgctgctttctctttatcaaagtcgatacctacaactttttgtgctttcgctttcgttgaaatatcagggaactcaattggtgtttgaacaccgtgtttcgttaagatgactgcaagtttagtacgagcatcagctgcacgatctaagcctgttccgataacgtgaagaataacatcaggtgcgtgcatatgaccgccgtgtcctgcagctgagtaatcccaacgccattgtgcgtggcgaattgcttgcaatgcatctttcatttcttcttcagttgcacccgcttcccaagctcttttcgcttcaaagtgtgctttaacaagctgatcttccaaacggatcattacgtctttgatctgttttttatgctctttcacgcgagcttgtaagctctctttgctttgttcgtgacaagttttacaagtatgctcaaagttatcaaacggattgccgattttgtgatcggtatagactttaccatctttagtttctacttttggcatatggcagtcgatacaggttacaccgtttttaccgtgtgtacctaatgcccaagtttcaaagtctgggtgttgtgcttttagcattggtgcttttgataagccgtgaacccagtcagtgaatttgatttcatcaaagtatttttcaatgctatcaacatctacacctttatcccaagggaatgtcaccgctttttctttacccgcaaaatagtattcaacgtgacagttagaacatactgcggcacgttttccgtgtttatccagtgtatcgaatttccaaccgataacttctaacgcacgcaaaacgtgtgggcgagcaacacgcagtgccgctttgccatctttaaattcttgtgaagtggtatcgtggcagtccgcacaaccaataggattgacaatttctgaaccatatttagcccattttgcatcaaaataaccaacttcgcctttttctgcgatcatacgtggcacatctggacttttacacgcccagcacgccataggctgaggaccagaattttcgtccattggcgcaccagtacgcaagatattacgcacatcagtaaccgcatagaagtgaccacgaggcttattgtaatctttagagaatgcatagcctgtccacaagaccactaaacgaggatcttcttctaaagcacttgttacttctttagattcggctgttgcagcccaagattggtactgtaaaggatagagttcagcaaatttatggttagctgattcaattttcacatcaggttttggaccttcaaactctttggcttcccctgcacacgcagcttggaaacaccccaacatagccattgtcgcaacaaggctgttttttaacattttactgacttttttcacgcgagcctcctcacacataactcactacaaatgataatttttcttattaaaacaataagatagatataaataaaagatgtatgtgaaatgtataaaaagaatgaatgttttactagaggattctgcaatttgtttgaaaaaaatcaaattgcaaaaattgaatggtgattaaatgagctttgttaggcaatctttctctcttatattttctaactgattgattatcttctagttaagaaaaattttattcatgttaaaatagcctgcctacttagatgacagcagaatattatcaacgagatataaatgtcccgaaaactcacccaattttccgcttgggcaagctatgttggcttgctctcactctatacgttcagtttctgggcattatttgaacatagtgccgatgaaaccttttggtcgtggcaagaaacgtggcaaattttaaaatacagcaccttgcaagcaacgctgtcggcgagtttatctttgctgtttggtgttttgttggctcgtagctttttctacctacgttttcggagcaaaaccttgctctataagctgatttcctttgcgtgggctctgccttcgttggtagtgatttttgcattaatcggggtttggggaaattcaggttggatagcccatctcgctcaagcggtgggattgtcgtgggatttttccctgtacggtttacaagggattgtgttggctcatctgtttttgaacattccccttgtcgcaaagtattgccttgaagggctacatcttattccaacacatcagcaccaactggcgaaccagctcaatctgtctgggtggcactattttaggattgttgaattgccgatattaaaaggcattttgccctatgcctatgcgacggttttcctgctctgttttaccagcttcccaattgtattaatgttagggggggggcctaaatacagtacgcttgaagtggcgatttaccaagcggtgacttttgagtttgattttgcgaaagcggtgatgttaattatggtgcaaatccttgtggggattggcttacaactgataatggattgggtgacacgctttaattttcagcgagtgaaaacacagtctgtatcgattgacatctggacggcacagcctaaaggtaaggaaaaatggctactacaagcggtgcttttcggggcaatttttaccattttattaccgcttgcaaatgtagtttggaccgccatttcagtatcaaacttttggcaacggctcttttcgccaacactttggcaatcggcaagctattcgctgttattaagtcttatcgcatcttgctttgtgatcggcattgcttatctactcgcccttgaaactcgccagcttgcttatcataaacagaaaatcaagcaaagcattctcgcaggtgtgagtacttatcccctgattttgccgatatttatgttagccgttgggctatttttactgctgatcaatgtgcaattaaccacttggcaactactattgttggtgggaatttgtaacggtttgatgttactgccttatatctatcgcttgttgttttcagcaatgtgggaagccttagtttctcacgataagttggctcgtagtttgggattaacggggcttcgccgttggtggattgtggaaaaaaattatcttatccgaccgcttatcaatgcttttgccctatcaatgtcggcaagtctaggcagtttttccgtgattgccttttttggtagccctgactttagcaccttaccttatttgctttaccaacaattaggcagttaccgtactgaagatgcgactattactgcatttcttttaatgctattttcagcttttccatttttctttatagaccagaataatcgctaaagacaaggcaaaacctcatacttctgtaaaataatttgtttgaaactgtcactacaacttgcccagtcaattaaatctactttaaatggcaaatctgagtctgaaaaagccagttcaagctgagcttgttggtgaattgttaagggggtatcggtaatcaatgcaaggtcaagatcggaaaatcgctttgccgttcctttaattcttgagccaaatacccatacgggaatattcggcaaatgtgtcgctagaatacgttgaacaaggtgtaactgttgttcgcttaaatctatcattggctacgtttttgaagttgagagagaagatagtggctacttactaggaaatgactaatgcctagatatacttgcatagccttattttcatcataagtatgtgatgtgatatttctcattttacgaaaatctaaccattcttcagggttctcaattaaaccaaattgagccgatagacgtaaaatatctctaaattctgtgctgtctatatcagtatcattggaagcaatacttttcagctgacgcttcatcattttaattgataattcatagacaaactcaaatttttgaattgctcctgcaataagcgtatcttggataattggatcttgagcattaaaccattcttgattatctaagtgagtaatcgttttttgcagagaaacaaaggctttttcaagtgccgaaatatctaatgtttccatctttttgttactttcctataaatcttaagcggtcagatccgtatatttttttgcaaatccgaccgcttgattatagctgattagccaccgaaatcatctaataagatgttttcatcttctacaccaagatcttttaacatcttgatcacagaagcattcataattggtggaccacacatatagtattcacaatcttctggtgcttcgtgatcttttaagtagttttcataaagcacattgtgaataaagccagtgtaaccatcccagttatcgcctggttgtggatcagaaagtgccacataccatttgaagttatcgttctctgcttgtaagccgtcgaaatcttctacatagaacatttcacgtttagaacgagcaccataccagaaggtcattttacgtttagatttcagacgttttaactggtcgaaaatgtgtgagcgcattggtgccatacctgcaccaccaccgatgaagaccatttctgcatcagtatctttagcgaagaactcaccaaatggaccagaaattgtgactttatcacctggtttgagtgaccaaatatatgaagacatttgacctggtggtacatctgggttatttggtggcggagttgcaatacgcacgttaagcataataatgcctttctcttctggatatgaagccattgagtacgcacggataattggctcgtccactttagacacataacgccataggttaaatttgttccagtcttcgtgatattcttcgtcgattaacgctttgtaatcttcatatctcacagtgtgagcaggtgcttcgatctgaatatagccacctgcacggaatggtacttcttcgccttctggaatttgaagtttaagctctttgatgaaggttgctttgttatcattagagataacagtacattcccattttttcacaccaaagatctcttctggaagctccacttccatactgcttttcacattaacttgacacgctagacgataaccttcttttgcttcacgttttgtgatgtgtgaaagctcagttggaagaatctcgccaccaccggtttttactttaacgatacactgaccacaagagccaccaccgccacacgcggatgaaacgaagatacctttacttgctaaagcaccaagtaatttaccgccagctggcaaggtaattgctttttctggatcatcattgatagaaatcgtgatgtcacctgagtccactaattttgatttagctacaaggataagtactgcaagcattaatacaagggcagtaaataccacgataccgaaaataaaattatccattcgatacgctccttataattgaatgcctgagaaagacataaagccaagtgccattaagcctgcggtgataaaggtaatacctaaaccttttaagccagcaggtacgtcagagtatttcattttttctgtaataccagctaatgccacaattgccaacatccagcctgtacctgcaccgataccatataccacagattcagcgaagttatattcgcgttgaaccataaatgatacagcaccgaagatcgcacagtttacggtaataagtggtaagaagatacctaatgcactatatagtgcagggaaaaacttatccaaaatcatttcgagaatttgcactagtgcagcgataacaccgataaaggtgataaagttaaggaaagttaaatcaaccccttccactaatgaaccatcttttaagatgttctcgtaaacaatttggttagctggaactgcaatacctagtacaacgattaccgcaatacctaaaccaaatgctgttgaaactttcttagataccgcaaggaatgtacacataccaaggaagaaagaaagtgccatattttcaataaatatggacttaacaaatagacttaaataatgttccatcttatttctccacttgctctggtttccaagttcttaagccccaaattaagaagccgataataaagaacgcacttggtgctaataagaataaaccatttgcttgataccaaccgccatcttgaacagtttggaataccgtcatgccaaagagtttgcctgaaccgattaactcacgaatgaacgcaacaatcacaaggattgcaccgtagcctaaaccgttaccgataccatcaacaaaactttctactgggccagatttcattgcaaaggcttccgcacgtcccattacgatacagttagtaataattaaaccaacaaataccgagagctgtttagaaagatcgtaagcataagcacgcaataactgatccacgagaattacaagcgatgcgataatcgccatttgtacaatgatacgaatactatttgggatatagttacgaatcatcgcaatgaacatacttgaaaagcctgttacaaagcttactgcaatacccattaccaccgcagtttctagcttggttgttaccgctagtgcagaacagatacctagaatttgcaatgcaatcgggttgttattcacaacaggtgataacaagagatctttaagtttattgcttgccattagttagtccccgcttttaatttcgctaaatatggaccaaagccgttcgcaccaaaccagtatttgaatgaaccatcaacaccgttagaggtgagtgttgcacctgataagccatcaataccgtgatctttatcagctgaagcaccttttgcaatgcgaattgcagattcaccctgagcattttgtaattttttgcccacgaagttttgttgccaacgtttgttttcaatttcaccaccaagtcctggcgtttcaccttgttcgtagtaagtgatacctttgattgtattgccatctggctcaacagagacaaagccatacattacagaccataaacctgttccgtagaatggaagtacgatttgatttacttgtccatttgtatcttttacaaggtaaatttctgcatattttgcacgaactttgatatctgctttatcgtctgctggattgatagcgatactttgagctggatcttttgcagctgcttttgcatcaaaattcgctacgccttcaacataatcacctgtggcaagatcaacgattttagattcgatgtttttcacataaatatctttaatttcgcttttcttcgtgccttcaggtaataaaccagcaacacttaaaatgtttttctgtttatcaagggctttttgttcttcctgtgccgattttaacaacaccgcagaacttgccacgataagagaacagattaaacttaataaaaccacgacggtaagtgttccgccaatgctatctttattaaacttagccattgcgtgccttcctacgtttgatgttagcctgaaccacgaagtagtcgaagattggagcaaacaagttagcaaataaaattgctaacatcataccttctgggtacgctgggtttgctacacgaataatcacacacatcaccccgattaagataccgtaccgccatttacctttattggtaaaggctgcagatacagggtcggttgccataaagaacataccgattgcgaaaccacctaacactaagtgccagtgccacggcatagagaataatgggttagtatctgaaccgattaggttgaataccgttgccattgatgccataccgatcattacaccagcaatgattcgccaagacgcaatgcgagcaaatacaataatcgcagcaccgatcattaatgcgacagttgatacttcaccgatagaaccaggaatattacctaagaatgcgtccatccaagtaatagtttcgcctgttgcaacgtgtttaagtgcagcttgaccgccgactgcccattgagaaagtgctgttgcgcctgagaagccatctgctgcagtccaaactaagtcgcccgaaatttgtgctgggtatgcgaagaataagaacgcacgacctgctaacgctgggttcataaagtttttacctacaccaccaaagacttcttttgcaaccacaacaccaaaggttgttgctaatgctgcttgccataatggtaatgttggtggaacgattaatgctaaaaggatagaagtaacgaagaaaccttcattgatttcatgtttacgcaccattgcgaataacacttcccagaaaccacctactgcaaaaatggttaagtagattggtaggaagaagatcgcaccgattaacattttgccaaatacgccagcatcttgtgataacacaccgaatgcatttgctaaggcaaagtgccagtcatttgccacgttttgagctacattttgagtaaagtcaccgacgcctaatgcaaggattgattgcgcacccacgttatacataccgtagaacatagctgggaacaatgctaaccatacgattaacatcatacgcttggagtcaattgcgtcacgtacgtgagcatctttttgagttactgtacccggtgtatagaaaatcgtataagctgcttcaaacagaatatagaatttctcatactttccacctttctggaaagccggttccattttatggaaaagatcttttaaagccatttgattaaccttccttctcgatcttatctaacgctgcacgcaacattggtgcgtagttatttttacctgggcagacaaaggtacataacgctaaatcttcttcatctaactctaagcaacctaatgcttgagcagaatccgtatcgccagatgctaaatcgcgcaacaacaatgttggtaaaatatctaacggcatgacacgctcataagagccgattggcaccattgcacgctcactaccattaacagcggtggtaaagttaaacaatttcttgctaaacgcacctaacacagtacgagtaatagagaatttgtgtgaatatggagcaatcatacctaagaactcttgctcacgaccttctgcaatcacagacacctgtaatgcataacgacctaaataatcgtgaacaccaactgctttcgcaccgcttaacacagagcctgaaatcacacggttttcaccctctgctagttcacctgcagttaattgagaaaggtttgcaccaagttgtgtacgcactaagcgaggttttttcacttgaggaccagctaacgaaaccacacgatctgtgtataattcccctgtcgtaaataatttaccgatagcaatcacatcttgatagttcaaataccacacacttttcgtcgcagaaacaggatcgataaagtgaatatgcgtaccactcaaacctgctgggtgtggaccagcgaaagaagttactttcacattagccacttcagccgttgggatattactatctggtgcacgacataaatggattgttttttgtccatcaaataaacggcttaacaccgttaaaccatcaacaaaatcttgtttatgttcatttaataccacttcaggatcagtcgctaatggatttgtatccatcgcattaacgaaaatagaagatggcactgcatctaacgcaggaactttactgaatggacgagtacggaacgcagtccataaacccgaattaactaaattttgcttcacttggtcagctgttaatgaacttaactcagaagcgttataacgctcgaaagttacctgttcatcaccttcaactttaatcacaacggattgaagaacacgtttctcaccgcgattgattgcaacaatcgtaccgcttgcaggagcggtgaaaaccacgccagcattcttcttatcttcaaaaagaacctgaccttttttcaccacatcaccttcacgcaccttcatagaagggcgcatacccacatattcttcgccaagcacagcaacttcattaacggtattaccgttatggattacttgctcaggtttccccgcaataggaagatctaagccttgtttaattgtaatcatattgtttgcactacttttagttgggttaaaaagaatgattgcagaaactgcaatcgctacattgagcgtagctaaaagcaaacataaacgttgattcccccacttatatttgttcgctacattaagttctcaaattgggctttaccttgtttttccaagataaaaataaacaaggtattctacctgaaaacacacttttattgctagttttactacatttttttaacatttagcctaagaaactttgaaatacatcaaattttactctttattccctgacaaaatgaatgaaaaacagacatttcctaaattcatttttaataaatttgatgctagtcaaaaaatcaggatagggataaaatagcaaacagtttagttttcataaatggataaaatgatgaacattacaatctcagacgttgcacaaaaccacttccgcaaattacttgatcaacaagaagaaggcacaaatatccgcatttttgtggttaatcctggcacaccaagtgctgaatgtggtgtatcttactgccctgttaatgccgtagaagaaacggatactgaaatcaaatttgaacaattttctgcatttattgacgaaatcagccttcctttccttgaagatgccgaaattgactatgttaccgatccaatgggttcacagctcactttaaaagccccaaatgccaaaatgaaaaaagtggcagatgacgcaccttttattgagcgcttagactatgtgattcagacccaaatcaatccacaactggcaagccacggcggacgtgtaaccttaattgaagtcactgaagataaatatgcagtattgcaatttggcggtggttgtaacggctgttcaatggtagatgttaccttaaaagaaggcattgaaaaacagttgcttgctcttttcccagaagaattagttggcgtgaaagatgtgactgaacatcaacgcggtgaacattcttattattagcaaaacaacctaactcaaacgataactatgaacgccaagcgtggcgttcctatgattattttcgggcacttatagtgtgctctttgtagtgccaataccatatcacgaaaaataacacgactatttcgttcacattttgaaatttcctccagggcaaccgcatatgttgtccatttttcaacctacacgacgagcaacagctcatctcgaaattcatctgaccaaccagcagcggtcaatttccctttcatactctgctttttcgggtgtaatcgtgccaagttcaacgctaatcgacgcaagattgccagattttccgcaccccattcatcggtcacagcacattcgtcttctttatagaccacatctagcacccaatgggctttgttttccacttcccaatgccttagcacgcacttcgtcaatatttgaatatcaacatccaagctactgatataaaagactttttcttgcgattctttgtcattatctgaccgcttgcgacacacctccaacaccgattttatccccttccattcctccgctttgctcagccaatcactcactttcagcttgcggtagtaacgctcatcaattcgacgacgttccgcatttacctcctcaaacgtctcaagcatttaatgcgttttattacacgagcgatagtatcatcgacaggaataccacactcaaaaggacgatattttcgcaaccaatccaaatgtaattcgccaaaaagtttgatttcagtccagctgtttgcccccgaaatcacggcactgacgacgagaaaaacgatgtctaaaaagtggtgtttttgattataggctcgtgggtcggataaattttcaaaaaaacgaaaaacgctcattttacaacctgatttgatatggataattaaggtgtattagatcataaatttgagaaagatgtgatcttgccctgtattacattgaagaatctgaatgattggactttacaagagatagaaaatactatttctattatttaaggcataaaaaggggcatagtagacaaaattgttgctaatgtttattttcgaacgagctgtgacttctaatacaaaaaattcaaggagctttttttgtgtagatttctttaatttacaattagttattttcatttttatagactaacatacttgataatctaatacagcccctaaatgaaataaaagcggtcaaatttgcagaaatttttgcaaattgctcaaaaaagttagacaatcctaccgcttacaacactgatataaggaaacattatgctaaccaactacgaagaaactatcttcagcaaaatcatccgtaaagaaatccctgcggcaatcgtgtatcaagatgagcttgtcactgcattccgtgatattgccccacaggcgaaaacccacattttaattattccaaacaaatttattccaacggttaatcacgttactgcggaagatgaacaagcacttgggcgtttatttaccgttgctgcgaaaattgccaaaggagaaggcattgcggaagacggctatcgcttgatcatgaactgtaataaacacggtggacaagaagtattccatatccatatgcaccttgttggcggtgagccgttaggtaaaatgttggcgaaataagatgaagcacactttttctcttgttgcactattgagcgtatttctgaccgcttgtgggtcaaatccgcctagctatctgccatcaggcacaacgccgattgttaatatcgaagccaatgtcgcagagataacggacgttgtggcaaaatcggatgaacttgtggtgtttaataaaagtgaacaccctctgcatttaagctataaactgttttggtacgacaaaacaggggtgacgcaaaccttaaagggtgaagcaacatcgtcttggcaacatttgttccttgaacctaaacaacgccaagagattgctttagacaagccaacccctgaaagtgaaaactaccgtttttacttacgttttcagcgataatggcacttcaatggcttgaacaacagcaacaacaagcggtcagttctgtcacaaaattagcagggctgaccgcctgtagccatttggtcgaattagccaatggcgaacgttatgttttacgttcccagacccaacaagccactgattatggcattgattaccaacaagaagtggcttttttgcgtttgattgagccactcggtttcgctcctaagatcatttatgctaatgaaacctctgctttattagcgtggattaatgggcaaacccctagccattttagccaacctttactcgctaaattagctgaccaattagccagcttacatcgctttgattggcaagcggtacgttctacgcaaaatttaacaagattaaatcttgccgaacgttgtcaatttttatggcaaaacttaccgcttaaaacgcaaaacagtctcaatttcacgcctccgtttaaacagattagtccttataaacaaactatttgccatcacgacattcatcttgcaaatttagtcgaacaagatgaaaaactctttttgattgattgggaatatgcggcgatctccgatcctgctttagaattagccttgctgtttcattacaatccgctgtctgcggaacaaaaggcgtttttcttggctcgctattttgcaaaatcaggcttcgaccccaccgcttgtgtcgccaaaatggtggaatatcagcctgaaatagagaaattgaataggttatggtttagattaagccactttttggatactatttttcaaacttaaaaatgaacttacaattcgtagcatttacacttcagtcaaatccaaattcttcgtttcttttgacgcaaagagtgcaatcaatgtgataactgcattaattgcaaggtaaatccctacgccgattaagccataagctgcattaattttaattgcaaaagttgcagcaaccgttgcccccacaatagatgctaagttataggcaagtgatgcgccagagtaacgtacttcagttgggaataattctggtaataatgccgccattgggccgaatgtcatacccataaagaccatacctacgattaagaacgcaaagactgtcattggtgtaccgtttcctaagaagaaaggcattaataaaccgaaaatgccgatacctgttgtcacataaattaaccatttacggcgaccgattttgtcagcaaaaatccctgacaggctaacgaagataccaaatacaattgcacttaataagagtaatcctgtaaatgtgttagctggaatacctaggcccattgggtgtcctgctggtgatagcgttggtgcactttttgagtaaatttgagcaaaggcagtcataatgtagaacaacacataggtcgctgtcataatgaatgtaccaatgatcaacggttttaagtggtctttaaatacttcgcttacaggtgctgcgtgttttttgccttgagcttcagcttctctgaaaacgtggctttcgtgtaagctaagacgtacatataaacctactgcaacaagcacgatagatgaaacaaacggaatacgccacgcccattccactaaggcttcagcaccgaaaatgtagctgactaagaagaaggaggcgtttgctaagaataagccaattggcgcacctaattgtgggaatgtaccgaaccaagcacgtttaccatctggtgcattttcagtcgccactaatgctgcaccaccccattcaccgcctaaaccgataccttgtccgatacgacataagcagagcaaaatagttgcccagataccaatgctttcatagtttggtaataagccgatagtaaccgttgaaccgcccattaataataatgaagcaacaagggttttcttacgtccgattttgtccccaaagtgtccgaaaagtgccgaaccgattgggcgagcgaagaatgctagtgctaatgtagaaagggaaagtaattcatttgaaacagggtcatcgctgttaaagaattgtgtgttaaatactaatacagctgctgccgcataaatgtagtagtcaaaaaattcaattgcagtcccgatcattgctgcaatcgccactttgcgtggattatttcttagagtatgagttgtcattgtcaaaaatccaaaggtttccgaaaaaaagagagtgtaaattaacacgccaaaaccaataaaacaaccctatttttagtattaaaatctatacaatcacttataaacgccaattaaagcactataacaagaatattattcttatattttagataaattagttttttattctatttttatcacgctaaaaaaggataaaaattttttaacatctaatgctaaaaaccaccataagcggatagatttatgcctaattttgctatgcagattaacttttacttgtacgaattttatttatccgtataatgcacagcttcagtcacacctgtttttaatccttgcttccaacgctggtgactggcaaccttggaggctgttaacccgtaaggatcgacaatgcgtcactacgaaatcgtttttatggttcacccggaccaaagcgaacaagtacctggtatgatcgagcgttataccgcttctgttaaagaagcaggcggtcaagttcatcgcttagaagattggggtcgtcgtcaattagcatacccaatcaacaaacttcacaaagcacactatgtgctaatgaatgtagaagctccacaaaacgtaatcgatgagttagaaactaacttccgttacaacgatgcagttcttcgtagcttagtgttacacactaaagcagcggtaacagaagcatcaccaatgcttaaagcaaaagatgagcgtaaagctcctgaagctttagtagaagttgaagctgaggatgcagacgagtaattcgtctattgataactgtttaatcttaagtggcactatcgcaacaacgattaaacaaagcctaagcccgataggtattccaacttactctttttatttagaacatcgttcggtacaaaaagaagtcaatttagaacgccaagcgtggtgcaaaatccaagtgattttagcaggcaatcaatttagtttaataacccaacaaatgaaggtcggtgggaaagttcgagtaaaagggtttatccatactcacaaagactacaacgatttaaatcaactagtcttacacaccgaacagattgaatttatagattaggagaagccaaaatggcacgttatttccgtcgtcgtaagttctgccgtttcacagcggaaaatgttgttgaaatcgattacaaagatatcgctacattaaagaactatatttcagaaagcggcaaaattgttccaagccgtatcacaggtactcgtgcgaagtatcaacgtcaattagctcgtgcaatcaaacgcgctcgctaccttgcgttacttccatacactgacaaccatcagtaataagagaggaagagtacaatgcaagttattttattagacaaagttgctcaacttggtaccgttggtgaccaagtaactgttaaagcaggttttgctcgtaactacttaatcccacaaggtaaagcagttatggcaactgcagcaaacattgctcactttgaagcacgccgtgcagaattagaagcgaaagcagcagaagcattatctgcagcacaagctcgtgcagcagcaatcgctaacttagcagcaatcgtaatcacttctaaagcaggtgatgacggtcgtttattcggttctgttggtgcgcgtgatattgctgaagcagtatcagcagcaggcgtagcagtaactaaatcagaagttcgtttaccagaaggtgcattacgtactatcggcgaacacgaagtgaaattacacttacacgctgaagtaaatgcagtagtaactatcaacgtagtttctgagtaatttacgattaaagtaaaaaatccccagccatttggttggggattttttacatcttttccaacttcgccactttggcaattaaccacttaatcccttgttgtacaaaggcaatttgcaggcgagtatgatcaccgctgccttctacattgatgattgttccttgcccaaatttctcgtggcgaactttctgccccattttccaaccactatcttcttgtaaacgagcggtcggattagcttgtggttttgcaaaagtagcagggcgattgatacttccacgcaggcggacttcccggatatgctcttcaggcagctcgccaataaaacgtgacggtaaatggcgttcttctttgccgtacaagcggcgactttcggcatagctgatcgtgagttttttcttcgctcgtgtaataccgacataagccaagcgacgttcttcttgcaagcgaccttcgtcgaagctcattccgcttgggaaaatcccttcttcaaccccaacgataaacacccgtggaaattctaagcctttggctgaatgtaatgtcattaattccacataatcttgatgtagtgaagcctgtgtttcgccagcttcaagggaggcgtgagttaagaaagcggtgagatcggtcatctcttctgcttcatctggttttacaaattggcgtgttgcagtcactaactcctctaagttctcaatacgaacttcgcctttttcccctttttcttgcttatacatttcataaagcccagattttttaatcacaaaatccgtctgttcaaacagtggcatttcttcggtttcttgttcaagtgcgttaatcagttcgacaaagcgaagcaaggctgaggcggaacgccctgagagatgttcttcttgaacagccacttggattgcttgccacaaggtgatttggcgagttcgagtaagctgacgcaaaatatctaaggtgcgatcccctattgctcttggcggtgtattgaccacacgttcaaaggcagcatcatcttggcggttagcgattaaacgtaaataggctagggcatctttgatctcttggcgttcaaagaaccgcattccgccataaattcggtaaggaatgttggcttgaattaaggcttcttcaataacacgagattgggcattgccacgataaagcacagcacattgattaaaatcaccttcatcttctttccattgcttaatctgtgaagcgacaaagcgagcttcatctaattcattgaatgcacaataaatatcaacgggatcaccgtcgcctttatctgtccaaagatttttccctaagcggttgtcattgtttgcaattaacgcatttgccgaatttaaaatatgtcctgtggagcggtaattttgttcaaggcgaatagtttgtgcgttgtcataatcattcaagaagcgttgaatgttttccacttgagcaccacgccagccgtaaatagattggtcgtcatcgcccacaatcattactttgcccgtttttcctgccaataaatgaataagatcgtattgaatgttattggtatcctgaaattcatcgatcagaatatgctgaaaacgttgctgataacgttgtaaaatcaatgggttatatttgaataattcataagcacggattaagagttctgcaaagtccaacaaccctgcacgatcacaagcctcttgatagatttgatagaatttaacgagctgttgtgaatggggatcatcgtgagattgtttgagatcttttgctcttagcccctgatctttttgagcattgataaaccacgccacttgtttcggtggaaactgcttttcatctaaattatgcaatttgagtaagcgtttaatcaaacgttgctgatcttccgtatccataatctgaaaatcttgcggcagattggcatcaagataatgagagcgaagtaagcggttagcaatgctatggaatgtaccgacccacataccgaataagcggtggtcgctagattgcgatagggtatattcaatacgatgacgcatttccgctgcggctttattggtgaaggtcacagcaagaatattggactcagcgatattttcaacgccaattaaccacgcaatacggtgggtaagcacacgggttttcccactacctgcacctgctaacactaaatagttgccaataggggctgctaccgcttctcgttgtttatcgtttaagccgtcaagtaataaagaaaaatccatctccgcctctttatgtgattttatacagtgtgattattataacctacaattacagatatgtattttaattttttcatcaaaatttttacctcaaatttacaaaaatcacttgcatagttatgcaataaaatttaatatctattcagttttaaaactttgataggaagtagttaatggcaattcgcattagtaatgtcaatttcttttacggttcgagccaagccttgtttgatattaatttaaacattgaaaaaggcgataccgttgtgttactcggacctagtggagcagggaaaagtactttaatccgtactttaaatttaatggaagtaccgcaatcaggtcagcttgagattacaaatcataagtttgatctgaccgctaaaaccaatgcgaaacaggttgcattattacgtaaagaagtgggaatggtgttccagcaatatcatttatggccacatctaacagtaatgcaaaacttgattgaagcaccaatgaaagtattaggtttaacgaaagagcaagcggtagaaagagccaaaggtttgttagcacgtttgcaacttactgcatttgcagagcgttttccgttacagctttcaggcggtcagcagcagcgtgtggcgattgcaagggctttaatgatgcaaccggaagtattgctttttgatgaaccaacggcggccttagaccctgaaattaccgctcaagtggttgatattattaaagagttacaacaaacagggatcacccaagtgattgtgacacacgaagtttctgttgctcgtaaagttgccactaaagtggtgtatatggaacaaggcaaaattattgaaatgggcgatgcaagctgttttgaacaaccaaaaacaacgcaatttgctcaatatctttcacattcagattaatcacaacatcatacaattaataggagttactatgaaaaaattacttttagcaaccgttttagccgcaactgcagtttcagcttatgcgaatgataaaattacttttgcaatggagccaagctatccgccatttgagcaaactaatgagaaaggtgaaatcgttggttttgatgtggatattgccaatgcaatctgtaaagaagtccaagcgacttgtgaatttaaatctcaatcgtttgattcgttaatccctagcttaattaaaggtcgtggcggttttgatgcggcaatttctgcgattgatattacagaagctcgtgcaaaacaagtggctttctcagcaccatactacgaaagttcagcaagctatattgctttacaaggtaaagatttagcatctgctaaaacagtaggtgtacaaaatggtacaacttaccaacaatacgcaacggcagaagctaaacaatatcaagcaaaatcttatgcgagtttacaggatgcaatcttagacttaaaaaatggtcgtattgatttaatctttggtgacactgatgtgttaagagatatgttaggcaaaatccctgaagcacaatttgttggcgagaaagtgacagataaacgttatttcaacaatggcttaggcattgcagtgaaaaaatctaacactgagttagttgaaaaattaaacaaaggtatcgcagcgattaaagcaagcggtgagtaccaaaaaatttatgataaatggatgactaaataatcattatgtttttggattatcttcctctattgtattctgcagccctaatgaccttagggttggcagtttgctctttattgctcgggttactattgtccattctttttgtggtgcttgaaacgcataaatggacaatggtgcgtaaaccaaccacagttgttgttgcgttattgcgtggtttgcctgaaattttagtggtctttttaatctattttggtgcgcctgaagtgcttgaaatgatcacaggggaatatgtcgaactcggtgcatttggctgtggtgtcgtggcactatctattatttttgcttcctacgcttctcaatcattgcgtggagctattcaagctattccgcttgggcagtgggagtctggggcagctcttggattaagtcgtggctatacttttgtaaacattgtgatgccacaggtttggcgacacgccttaccagggttaagcaatcagtggttagtgttattaaaagataccgctttggtttctttaatcggtgtacacgatattatgcgacaaacggagttaattaacaccagtacccatcagccatttacttggtacggtacagcagcattaatttaccttggtgtaacattagtcagccaagtaattattcgtaaattagagctacgcttcactcgttttgaaagagggggtaaataatgttgcaagaatactttatggtgatagctcagggtatcccgactagtttattgctgacgtttgtttctttaatcgtggcattttttcttgctgttggaatgacgtttttactttcaatggaaaatcgtctagtaaaaggaatagtaaatggctttttaaccctatttactggaacgccattgttagtacagtttttcttgatttatgcaggtcctgggcagtttccttggattgtcgcaagtccattttggtctttgttatcggatgcgtggttctgtgcaatgctcacccttgctttaaatagtgccgcttataccaccttactatttcacggtgcagtcaaagcgataccaaaagggcaatgggaaacctgtgcggcattaggattaagtcgattacagacattgaaaatccttgttccttatgcgttaaaacgggcattaccgtcttacagcaatgagattatcttggtgttcaaaggaacatcactggcttcaaccattaccattatggatattatgggctatgctcgccagctttatggaactgagtatgacgcattaaccatctatggtttagcaggtgcggtttatttggttattacagggattatgaccgtaatcttacgcagagttgaacgcaaagtgctttcttttgaaagattagaggcggaaaaggcgtaagaattgaaagatatggcagagtagatgaaaattaatgaccctttgcccgtaatttttgtctactatgccgttcttaatctattcctctaatggttcttcctcaatcggagcttgtccttctgcttcgtcggctttatttggttgggtttgaggggcatctttgcctagtgacaatgcgtcccacacacttggttttgcttcaaccatagaaccgccacccgtacaatagcgttgtcctttatctttccaaacaggaatttgacgagggctagagcagtcccaagagccgtagctgttgatacctacccattgaatagttggtatgcttggtagcttgaacaccaagggttcggcacgtttaaggtactctttatatatttgcaacgcaccgcttgaactggtgagataggtatcgctattgttatctttacctaaccaaacggtcgtgacattttcaccgtctatgccgacaaaccaagtatctcgtgcattgttggtggtgccggttttgcctgcgatatgcagttgtgcaaaatctgcctgtaggctacgagctgtacctcgctccgtcacttgttgcattgcataaagtgtttgaattgtggcttctgcaggcaaaacgcgtttacttgtctgcgtgagaacaggctgataaattatttcacctgttggggatatgatcgcttcaattgttgtaagcggtacttttaagccagcatttgcaataacctgataagacttcgtgacatcataaggtgaaatagaataagagccgagcaatgtcgcaggataaggcggaatttcggcattatcccagcccatttctttctgcttggcaatcacatttttcagcccaagtttcattccaatgtttaccgtaggaatgttaagggaacgaactaaagcgtccattaacatcacagaaccgctaaaacgacgatcatagttacgaggtgtccaagtattacttccaacggtaatggtaatcggttggttagctatcggcgtgttaagacggaaatactgcggatttgccaaagcaatggcataaatagacggtttaaccaatgaaccgatttgacgtttggtttgaatagcacggttaaaaccagcatattgtgtctgaactcccccaacaatcgcccgtactttacccgttttatattccgccaccacaatagcagattgcaactctttgattttcttactgctattttctaattcggataccccattgataaccgccatttccgcagaacgctgttgttttctatctaaagtcgtgaaaatttttgcccctgacagcagagcagatttgttctcacccaactgacttttaatatctaaatttaaggcgtgcataaacgcaggttgctgacgatagatattccctttctctttcacgccaagcggttgtttactaagtaaattatacaattcttgattaatcaccttatgttctagcaatacacgcaacacaacattacggcgttctaatgccccttctggatttttccacggattatagagggacggacctttcaccattcccactagcagagcgatttgatttagattaatttcttgaataggacgaccaaaatagaattgacttgccagagcaaaaccgtgaatttgataactaccattttgaccaagataaatttcatttagataggtttcgagaatgcagtttttatcgtaacgaaaatctaaaatcagcgacattaacgcttcatttactttacgcactaaggttttttcattacttagaaagaggtttttaactaattgctgagttaaagtactgcccccttgcactgttctgcctgcttgatagtttgtcaaaaaggctcgagcaatccccagtggactaattccttcgtgttgatagaaacgcttatcttcggtaagtagcaacgcatcaataagcagacgaggataattctgcaaacgtaacgcttgacgttcttcatcgttatccgaatgcaacattgcaatcattttagggtcaagacgaaattccttgacctctttaaattgcactaaatcttcaatacgagcgagtttatcactgacaaagcgtaaacgcagtacacgttgagcttcaggattttcagggaaaggaaaagcacggcgaagcaaaacaagattgtcaccttcgattttgaaatcacctggtgttgcaattaatgaaacttcacgatagccattgtctaacaaggtgagtttgacttgctcaagggtaagattgtcatcaaggcgaatactttcgatacgactatagacctcggcaggcaattgccaaatttgtccgtccattttagaacgaatttttccatctaaatagatgccgtatatcccaacatagcaagtggctaagagagctagttttaagcaagttgggataaagtagggctttttcgctatgggttctttctgtttttcttttgtatttaacattatggctggctataattattcaacttatgaggtaaaattttacaggaaaattttcaaatctcacgtatatttctctattattgctcaatatatttaccaaaaattatagataatgtcattaatgtgaaaggaatattaaagcatgggtcaaaggattaaatatcataggaacacttggcaacatttaaatagtgatttatatgtcacatcaagactattctttttaatatggtatagatggaatatggcaaatataatccatgttttaggggctaatattccccatcacaatcacacaatactaaatttcttccaaaatgaattattggatgaactaccgaatgcttttcatttttatgttgttagtcgtagtgatttgtctgaaacttttacattattagatattaattcatatccagatgaatatttactcactcaagaagttatcaaaattgcaagaaaggaaccaaccgcttggtttgtgctacatgggcaattcaatgcatcgttgtggttagctatcttgttaggattagtcccagcaaatcgttgtgtttggcatatttggggagcagatctttatgagctctcttcttctttaaagtttagattgttttatccattgcgaagacttgcacaacgtaaaatagcacgcttgtggggaactttaggagatttaaatcacgcttatcaacaattaaaacgtaagagctctcttgatcaacggctttattttccaactagaatgtctacgaattttccgactaaaaaatgttcatatcaacggacaattttgttaggaaattctggcgatccgagcaatcaacatttacttggattaaagcaaattcgagagatatttggcgaaaatgtacgaatagtcgtgccgatggggtatcccgcaggtaattcaaaatatattgctcaagttcgccaacaagcagaacaatacttccaacaagggcaggtggacattcttactcaggaattagaatttgaggcttatctggaactactgtctcaatgtgatcttggttactttccttttgagcgtcagcaagggatcggaacgatgtgtttactcatacagatgaacatcccgatagccattcatagagcaaatccttttcaacaagatttacaagcggagggaattagctttcttttcgcagatgaaatcagtaattcagagattatacgagttaaatcccagttggctttacttgataaaagtaaaattacttttttccccctaagttataaacaagagtggctgaactgtttacattctcttggtttacaagcggtctaatttcagtaaaaattacccaccttgtttaaggaacattatcatgttagcgggattaatccttttttatgtaatcgctataagtgtgttggtttggataattcaacgagattatcgccagcaaggcttttcattccatttgctgtttagtggcatctatcttattacctttttcggtgggtttcctttttcgatgacgatggcagagctatttgaatatcgccttcctgccgtctcaatgttgtggaacgtactagcaatagctttaggcggctatcttatctattacgtgagttatctttatatagggagaaataagcaaataccaaggtatgcggtggaggtaaaatcgctagctaatctgaccgcttggattttaatgatgattgcaatactgagcctattaggatttatgttgttaaatcaagggctattgttattcaaattagaaaaatatagccacattttttctgctcaagttagtggtgtggctttaaaacgtttcttttatttctttttacccgccttgttaatttggtttttcttaaagcctactaaagaaagttggtggctatttttggtagctggaatgacatttggggtgttgagttacctagctgttgggggcacacgagctaaccttgcattagcctttgttatgtttatgctgttggggtatttgcggaggtttttatcatttaaatggctggtgagggcagggcttttgacagttattgcaatgtttttgttggcattatggcggtatcggcttaatgtacaaggttcggaagcattttacacttttctttatttgacacgtgataccttttcgccttgggaaaatgtagcaaaaataatggatgcagagattgagtttcaaggattaatgcctatcgtgcgtgatttttatgtgtatattcctcaatcattatgggaggaacgcccagacatcgtgtggaatacagcaaactatttcacgaaaagtgtattaggtaacttttctggtttagctatgtcgccaacgttattaggctctttttatattatgggggggataccaatgattgctataggaatggcggtggttggtggtttaatacgtatctttgataatttttttgcctatggaaaaaattctgcagttattcaaagttattgtttggcaaatttgttcaatttgattgtattgatacgagaaggcatagatgcttttatttcacggttctgcttctttagtgtgatttttgtatttgcttatatagtagcctatttgataaatagggtgagagagtggtatgaataaagtatcagttggtggagttgagttattagccgttgaaaatcagcaaactttggtagcctatttattgaataatggagttcttctaacaggtaaattgatagcaataaatgctgaaaaaattatgatttatcaagaagataatgaaatgaaaaggctattagaggaggctgaatataaatatgccgatggaataagtgtagtttgtactattagatctaaatatccgaagtattcgagaattgaacgcattgcaggcgctgatttgtgggagaggttgatggctgagttgggagaatgccgtttacctgttttcttagtcggaagctcagaggataccttacaagcaacagcaatgaaattgcaggaatggcaagtaaaagtggttggaacacaaaatggttatttcgctaaagagcaggaagaagaaattatccggagaataaaagcgagtggtgcgaaatttatttccgtggcgatgggctcgccaaaacaagaaaaatttatgcaaaaagctcagcaactttatcctgatgcactatatatgggggtaggaggcacttatgatgtctttgtcggtaaggttaagcgagctcctaaatgttggcaaaatttaggtttggagtggttgtttcgtattttacatcagcctactcgctggaaacgacagttgagattaatgaaatatgcttatttttatctaacaaaacggctataaagtttgtaacgtatttgggatacatattaacatttcacaaaaatcactttcttttttaaaaaattgtgagcaacttcacaaatttttatttaattgtttgcgtaaaatgttcttttttttatatctcaccctagaaaactttctttttcaaacatttttactttctaatttaatttccttagggggaatttatggacaaatcattaaaagctgcttgtattggtgaatttattggtacaggtttgattatcttttttggggcaggctgtgttgccgcagcacaggttgctggagccacattcggcttgtgggaaatttcaatcgtgtggggacttgcggtcgcaatggctgtttatgcttctgcggggttatctggtgctcacttaaaccctgctgttactattgcgttatggaaattcgcttgttttgatggcaaaaaattctgccttacattatttctcaaatgctcggtgctttctgtgcggcagcattagtgtacttcttatataaagatctttttgctgccagtgaagcggcacaaaatattgtgcgtggtgaaggtgtcggctttgcaggtgttttctcgacctatcctaatccacatatcagcgtattacaagccttctttgttgaagtggtgattaccgccgtattaatggcattaatttttgctttaacggatgatggtaacggtttaccaagaggtgcaatggctcctttacttatcggtttactcattgcgactattggtggtgcaatggggccattaactggctttgcgatgaaccctgatcgtgattttggcccaaaactctttgcattcttagctggttggggagatatagcgctcactggcggacgtgatattccttatttcctagtacctatttttggtcctattgttggggctttattaggtggctttatctatacccgtgttattggtaaaaatttaccatgtaatcttaaataattttcagaggtgatcgtatgactaaagaatacatcattgccttagatcaaggcacaaccagctctcgtgcggtgttattagacaaaaatgcaaacattgttgaagtggcacaacgtgaatttactcaaatttatccgcaagcgggttgggttgaacataacccgatggaaatttgggcaagtcagagttcaactttaaatgaagttgttgcaaaagcaggggtaaaagccgatgaaattgcggcgattggtattaccaaccaacgtgaaaccacgattgtttgggaaaaagaaacaggtaaaccgatttacaatgcgattgtatggcaatgtcgccgtacatctgatttctgtgaaaaattaaaagcagaaggtcacgctgactatattcgtaaaacaacaggtttagtggtagacccgtacttctcaggcacaaaagtgaaatggattttggataacgtagagggtgcaagagaacgtgcgaaaaaaggtgaattactattcggtacggtcgatacttggttagtatggaaattgactcaaggaagaagccacgttaccgactataccaatgcttctcgtacgatgttattcaacattcatgccaaacagtgggacgacaaaatgttggaactattagatattccacgcgaaatgttgcctgaagtgaaaaactcatctgaaatctacggacaaaccaacattggtggtatgggtggcgtgcgtattcctgttgcaggaattgcaggtgaccaacaagcggcactttacggacatctttgtgtcgaatctggtcaagcgaaaaatacttacggtacaggctgctttatgttgatgaacaccggcgatcaagcggttgaatcgaaaaacggcttattaaccaccattgcgtgtaacgccaaaggtgagccttgctatgccttagaaggttcaatctttatggccggtgcatcaattcaatggttgcgtgatgaacttaagattatccacgacgctcgtgactcagagtactttgcaactaaagtgagcagtacaaatggtgtatatgtggttcctgcatttacgggcttaggtgcaccatattgggatccatatgctcgtggtgctatcgtgggcttatcgcgaggtgcaaaccgtaaccacattgtgcgtgcaacattagaatctatcgcttaccaaactcgtgaagtgttagacgcaatgcaagcggacagcggtgcgaaattagcgactttacgcgtagacggcggtgcagttgcgaacaacttcttaatgcagttccaagcagatattctcaatgctaaagtagaacgtccgaaagtgctagaagtgaccgctcttggtgcggcttaccttgcaggtttggcaacaggtttctggggtagcttagaagaattacgcggtaaagcggaaatcgaaaaaaccttctctccagataatgacgaagaaaaacgtgcaagacgttacaaaggttggaaacgcgcggtgaaacgttcattagaatgggcgaaagaagacgctgaatagtttaccataaatagacaagcggtcagtttctgcaaattttttgcgaaaactgaccgcttatattttatgcctctttcttgtgcggaccgatttctttattatgcccttcatcaagatgaacaaaattcactaattcatcagcacttacttggaacgctttaccaaacccttttacaaataatccttgttgtggtttaaagcagaacagtttgaagtcttgcaaggttgctaactcatcgactaaatcgccgtgacgggcttttaatttggcaatgccatcattccactcatcactatagcgttcgacaatgcgagcggttgcgtcgaaggtcaaacggcgacgagcaaaaatttcacggctctgactttcatcttccagcaacattaacgacactttcggcacttcctgtaggttgcatgcgtggcgggcaatggtggaaatcaatacttgatattcaccattgttgatcacaaatggtgcataacttacattaggggttccctctttatccacagtggcaagcaccaatgttttcatttttgctttaaattcttgaatttctggccctaaacggttttgtaatacttcttgacgatttgacatttatcgctcctttttattgaaatgtcttaaatttttcaacttgtgttgggaagagttgccgctgctcatctcgaccgagatacactttaaaaatggtttgcccgttatgtgcaataaaagcaatgttgtagctttctttccctctaaacggcaagctaacaaaggcaattcgagcaatattatcaagctttaaatgcccgtgaagtgtgccttcttgatccttcatattcaaattgtaataacctcgagcaaagatcccgcttggaaaacggtctttaatttcaaaaatggagccttctttttcgatgatagttgtaaatgttccccattgactgatcgcttgtagaatctcttccgctctatctgcagagaacaagcggacaaattcactcggtaaattgcaaagcacttgcccttctgggagagctaatttttccgcaatttcaagggtaatcatattcgggttttcagcaagaagctgggtgatttgttgtctataagagttcatgttgttatgcacaagttaataatgattattatttattttatagtcatgctatgctggaatcaactacttttaccaatcgcttgcagattttgaccgcttgtgcctgttgaatgctggtgagccttgatgacactgctatcaataaaaatccattcagaatcaatatattgtctaaatgattttagcacttcttgccaaacaccctttttagaccaaagattgaaccgacgctaaatcgtgtttcacaagccaaattcagcaggtaaatcacgccaagggcatcccttacgaatgcgatataaaatcccttccactgtattacgatgttcaggtttattataaacacgtcctgtacggtcgagtaaataagctaggcgtttccaaagattatctgttaaaatagttctaagcgacatagtttgtatgggatggttaggttttggcgaactaaattataccaaatttctatgtcgtttgttttttgtacttaaaagatcaacacgccctatgcttacaaaaataatttattttttagacattacttatttgatgccatagaatggacagtacatcatagaaacatataaatgactttacgtataacaactatgaacatctggcaaacaaaatccctcgtcacttggctacttgcccctctctccctgcttttttggttgattagccaaattcgagtgatgttataccgcaaaaaaatcctaacatcttaccgctcgccagtgccagtcttagtggtgggaaatatttctgttggcggaaacggcaaaacacctgtggtcgtgtggttggtagaacagcttcaacagagtggcgtgaaagttggtgttatctcccgtggttatggtggaaaaaacaagcaatatccacagttagtcacagccgatagcaatcccgaattaatgggtgatgagcctgtactcattgcgcaacgaacactcgctccagtcgccatttcgccgaaccgccgacaaagcattgaactattattgagccaatttgagttggatctcattattactgatgatggcttacaacattacgcccttgaacgagatacggagtgggttgttgtcgatggcgagcgtcgttttggcaacggttttgtcttgccggcaggtggattgagagagcttccaagccgtttaaaatcagtgcaagcggtgatttgcaacggaaaatctgcacaagtaggcgaacatctaatgcagttagaacctgaatgggtaatcaatttaaaaacaggcgagaaaaaaccgataaccgatttttatcatcagtcggcgattgcccttgcaggcattggctatccgtctcgtttttttatgatgttgcaagagcttggcattcaacttaaagaaagttatggctttgctgatcatcaaccttacgcgttaaacataatcgaacctttacagaaagacggcttaccgctattaatgaccgaaaaagatgcggtaaaatgccgtagttttgctcaaccaaattggtggtatgtgcctgtttctgcaaaattttcagcacaagataccgcttgtttattagaacccgtccttgaattagtgagaaaacagaatgaacgaaaaactgcttaatacgatcgcttgcccaatcactcagaccaaattagagtgggataaagaaaacaaccgtttaattagccgttcggcgaatgtttattatccgattgaaaatggcattcctgtgttgttgccagagaaagcggagaagctataaagatatacaaactgtaagccagttaatcccagatttataacatgatactcaacccaaacagcaaatttgttatcaatgccaaccctgccatttgtccaaggataggacgaagttctgttggatgtttgtggcggtaaacaaataaaccgtgtttgactagtaaagggattgctaataagtataggaaattgtaccaatgagcaaaattcatcagagtgaataaaagataggatagtacagctaaactgagtaaaagaagatgataacgacgtccattctggctaccgatacggacaataagggtatttttacccgcttgtttatcttgctcaatatcgcgtaagttattgatatttaatactgccacagataatagaccacagccgaaagcgggaagtaatagatcaaactgtagggtatgggcttgtaagtagaatgtacctaaaacagctaaaaatccaaagaaaatgagtacggaaatatcgcctaatcctaaatagccataaggtttttttcctacggtgtaagtaattgctgcgacaatcgctaaaatgccaagtagtgcaaaaacaataagatcttgccaactttgataagcataaccaatcaatacacttccagatataaaagataatacagcaacaaaaatcaaggctgttttcaactgttgccccgaaatctcaccctgttgaattgctcgtaaagggccgatccgctgttccgtatcagatcctttgatgtgatcaccataatcattagcaaagttagacaaaatttgtaacaaaatcgttgtgataaaagccagtagggtggttagccaatcaaattttccttgccaaaaagctaatgcagaaccaaccaaaatagaagctaatgcaagcggtaaggtttttgggcgagccgttgaaagccaaatagagaacatagaacctttattcatatcaataaattagtcactttaatgaagtttttcttttaaaactgtgtattttattacaaaatgttcttatatgttttgatttttaacagaaaatttgcctttttatgacaaatccgtcctctttaaccctttctcccattggaacgatacaaacaccttatggggaaaaatttgccgttcctcgtcagcccaatttagtccgtgaagggcgaggtattttgcgtttgttgccaccttataatacgcctgatgcagtacgaggtttggaacaatttagccatctttggcttatttttcagtttcatcaaattcctgaacgagagtggcacgctactgttcgtcctccccgcttgggtgggaatgagcgtgttggtgtatttgccagccgtgcgacacatcgcccaaatccgttaggtttatcgaaggtggcattagatcgtattgaagttaaagagggcgaggtttatttacatttaggcagtgttgatttagtcgatggtacaccgattttggatattaaaccttacgttgcttatgctgatagtgaaccgaatgcgttatcggggtttgctcaagataaacctgaggtgaaattgcaagtgcttttgactgagcaagcattacaagcggtcaaatcttgtcagaactttgcgaaatttggcattgaagatcctgtgcaatttttatgtgatgtggttgcacaagaccctcgacccgcatatcagcaaagtaaaccaagtgagcgaatttatggtatgcacttggctggctataacgtgacttggcagatagataaggtgcgacaggatcttgcacatattttaaacattgaactaatcaagagaaatacgttctaagtggtgttttacgccctgatataaaaggaatagagaatgacattgaaaaaatatttagccattttaccgcttgtatttacctcattggctgtatcggcagagccaaatacctttgataccaactcgactttccagttttcaacgcaagtaagtcgtgcggtggataaagatctgatgaaagctgaggtatatagcagaatgtcaggtaaaaacctgaatgaactgaaaaagcaagtttctgctcatctcaatcaggtgattgaattagcgaaacaagataaaagcattgagttatctacagatggcattagtaactatccagaatacgataataaaggtaaggtgacaggctggttcgcagaaggtcgcattcagttgaaaagtaaaaattttgacgctatggcaaaggtgcttgagaatttaggcgatgatgtggcgattggtcaaattcattttagtgtgtcgcctgaaaaattagcttctcttgaagatgaaatgacgttagacattattgctcagtttcagcgcaaagccgaagttattcaaaaagggctaaatgcgaaacgttatattattagtaatgttcagttagaaacccctaacggacaggaacatcatagccgtccaatcgcactaagagccgcaagttatgcgaaagaggcagatgtggatattccacttgagacaggcaaagccactatttctgcgtttgcttcggggcaggtgaaatttgaaaagtaagggcttgaaatgaagaaatggattaagttactcggtcttactttactttgcacttcggtaagtggctgtttagtcacttctgttgttggtggtgttgttggaactgccgttgatgtggttgatgcggtgacacctgatattgtggattaatttcaaaatttgaccgcttgtaagaataagcggtcattttgttactaacatttgcaaatcctctataacaagctacaatgcctagaactttttacccaataaaataaggatacttaaatgaaaattaccaaaaatgttgtgcctagcattgcataccaagttcgtactcaagatggcgtattagttgatgaagcaccagttgagcaaccattagaatatttacacggtcacaataaccttgttattggtttagaaaatgcgttagaaggtaaagcggttggtgatacctttgaagtgcgtgttaaaccagaagaagcctatggcgaatacaatgaaaatatggtgcaacgtgtgccaaaagatgtgtttatgggcgttgatgaattagaagtgggtatgcgttttatcgccgacacagatttaggtccattacctgtggtgatcacggaagttgatggcgatgaagtggttgttgatggtaaccatatgttagctggtcaagagttattattctctgtggaagtggttgcaactcgtgaagcgacattagaagaaattgctcacggtcacgttcatcaagaaggtggttgctgtggtcacgatcacgatgaagatcacggttgctgtggcggtcatcacgaccacgatcatcaccatcacggacacggcggttgtggttgcaaccactaattaaaggttggttgaacgatgagtgataccccattacaatcaggcacggattacctccgtgccattttaagctctaaaatctacgatcttgcccaagtcacgccattacaaaaaatggaaaagctctcagagcgtttgggtaatcatatttccattaaacgtgaagatcgccagccagtgcatagttttaaactgcgtggggcttatgcgatgatttctaatctctctccagctcagaaaaatgcaggggtgattgcggcttctgctggtaatcacgctcaaggtgttgctttgtctgcgaaacatctcggtttgcgagcgttaattgtgatgccacaaaatacgccgtcgatcaaagttgatgccgtacgtggttttggtggggaagtgttgctccatggagcaaattttgatgaagccaaagccaaagcgattgagctttcccaagagctgaatatgacctttgttcacccgttcgatcacccgctagtgattgcaggacaaggctctatcggtatggaattattacaacaaaatgccgatctgaactatatttttgttcctgtcggtggcggtggtttgattgcgggtattgctgtgctgattaagcaattgatgcctgaaattaaagtcattggggttgagtctaaagattccgcttgtctattttatgccttgcaagcagggcaaccagttgatttagaacgtgtggggttatttgctgatggtgttgcggttaaacgtattggcgatgaaacattccgtttgtgtcagaagtatgttgatgatgttgtgttagtcgataacgatgaaatctgtgcggcattgaaagatgtgtttgagaatgtgcgtgcggtggcagagccgtcaggggcattatctttagcgggactgaaaaaatatgtggctcaacacaatcttgaaggtaaaaatctcgcatgtattttatcgggggcaaaccttaacttccacacactacgttatgtgtcagagcgttgtgaaatcggcgaaaaacacgaagcactcttagccgtttctattcctgaacaaaaaggcgcttttctcaagttctgtcaaattattggtaatcgtgcggtcacagaatttaactatcgtcacgcagacgatcagcaagcctgtatctttgtgggcgtgcgtattagtgggaatgctgaaaaattagagatcattaaagatttacaacaaaatggctatccagttaccgatttatccgatgatgacatcgcgaaaacccacattcgttatatggtcggcggtcgcccaagttctattcagcaagaagaattatacagttttgagttccctgagcagaaaggggcgttgttgaagttcttacaaacgttaattgattgggatatttcactgttccactaccgagctcacggtgcagattatggtgacatcttggctgcatttgttgtgaacggcagtgaaaaagaggcatttaaacaagatttagaccgattaggttatcgctatcaagatgttaatgatagtccagcatatcaatattttttaaggtaattatttatggcagaacgtaaatattttggcaccgatggggtgcgtggcaaagtagggcaatttccgattacgcctgattttgcattgaaattgggttgggcagcaggtaaagtgcttgctactcaaggctctaaacaagtattaattggtaaagatactcgtatttcaggttatatgcttgagtctgcacttgaagctggcttggcagcggcaggtttatccgctgcctttacaggcccgatgccaacccctgcgattgcctacttaactcgtacatttcgtgcagaagcagggattgtaatttcagcatctcacaacccttatgatgataatgggatcaaatttttctctgcaatcggtgaaaaattaccagatgaagtcgaagaagcgattgaagcaatgcttgatcagccgatggattgcgtggcttcagctgaattaggtcgtgcaagtcgtattaatgatgcggcaggacgttacattgaattttgtaaaagtactttcccatcatatttaagcctagatggttataagatcgtggtggattgtgcaaatggtgcaacttaccatattgctccaaacgtaatgcgtgagttaggtgcagaagtgatcgaaattggcacacacccaaatggtttgaacatcaatgagaaatgcggtgcaacggacattaaagccttgcaacaaatggtagtcgaagctggtgcagatgtcggtttagcttacgatggcgacggtgaccgcttaattatggtcgatcacttaggcaacaaggttgatggtgaccaaattctctttattattgctcgtgaagcattacgttcaggcaaattacacggcggtgtcgttggtacattaatgagtaatatgagccttgaacttgccttaaaagagttagctattccgtttgcacgagcaaatgtaggcgaccgctatgtacttgaagtcttaaaagaaaaaggctggaagctcggtggtgaaaactcagggcatattatcgtgttagacaaaaatactactggtgacggtattgtcgcctcactcgaagtattggctgcaatggtatcacataaattaagcctaaatgatctggctaaagctgtgccgttattcccacaagtgttgatcaatgttcgttttgcaggtggtgcaaatccattagacagtgatgaagttaaagctgttgcaaaagatgttgaacaacgtttagctggcaaaggtcgtatcttactgcgtaaatcaggtacagaaccgctaattcgtgtgatggtggagtgcgaagatggggctttagcacaaagttgtgcggaagagattgcagaagcggtgaaacgtaactaatcgcaagcggtaagatttcaacaaaattttgtaaggatcttaccgcttgttcttttttaggctataataacgcaaacgtttgctttaaggagaacgctatggatcaacttgagatgaaaaaaattgcagctcgtgcagctttgcaatatgttaaacctgacactattgttggtgtgggaagtggctcaactgtaaactgttttattgatgcattaggtgaaatggctggtgatattaaaggtgcagtagccgcttctaaagcatctgaagaacgtttaagagcgttaggtattgaagtatttagtgccaatgaggtgactgagcttgatgtttatattgacggtgcagatgaaattactccgcaaggctatatgattaaaggcggtggggcggcattaacgcgtgaaaaaattgtgagttcacttgcaaaaaaattcatctgtattgttgatgcaagtaagcaagtagatgtgttaggctctactttcgctctgcctgttgaggtgatcccgatggctcgttcttatgttgctcgtcaattagtagccttagggggatcgcccgaataccgtgaaagcgttgtaacagataatggcaatgtgattttagatgtgtataacttcaaaatttttgagccattaaaaatggaacataccatcaataatatcgcaggtgttgttactaacgggatttttgcacaacgttatgcgaatgtgaccatcgtaggtacgcctgatggtgcaaaaattattgaataagaaaaatcactacggagggttgggggttgctactcaactctcttctgtataaggaaggcaatatgacaaccaaagtttctttagataaatctaaaattaaatttttactgctggaaggcgttcatcaaaatgcaattgatgttctgaaaaatgcaggctataccaacattgaataccataaaaaagctcttgatggtcaagagctaattgatgcgatcaaagatgctcattttgttggtatccgttcgcgtacttttataacagatgaagtcttacaacaagctcaaaaattagtagctattggttgttattgtattggaaccaatcaagttgatttagatgcggcaaaacgtcgtgggatccctgtgtttaatgcacctttctcaaatactcgttctgttgcagaattggtgttaggtgaaatcatcgtgttaatgcgtcaagtgccaaaagcaaatgcggaagtacatcgtggtatttggaataaatctgccgctggttcaaacgaagtgcgtggtaaaaaattagggattatcggctacgggcatattggttcgcagttaagcattattgccgagtctatcggtatgcaagtgtatttttatgatattgaaaataaactaccgcttggaaatgctcaacaagttgctagccttgaagaactactttcaacctgtgatgcgatttcattacacgttcctgaaaatgcttcaacaaaaaatttaattgacgcaaaacgtttagcccagatgaaagaaggtgcagtattagtgaatgcagcgcgaggaactgtggtagatattgatgccttagttgaagtattaaaaacagacaaattgcgtggcgcagcccttgatgtgttccctgaagagccagcttctgcaagcgatccgtttgagtctccactttgcgaatttgataatgtgattttaaccccacacattggcggttctacatcagaagcacaagaaaatattggcactgaagtctcaagtaaatttgtaaaatattctgataatggctctacattatcagcggtcaatttcccagaagtttccttgcctgaacataaaggcacaaaacgcttattgcatatccacgaaaaccgcccaggtattttaaatcaactcaataaagtcttcgttgatgcgaatgtgaatattgccgcagaatatctacaaactgatccgactattggttatgtagttatcgacgttgaaaccgaacagactggcgaggcattaaaatgtttgaaagagattgatggaacgattagggctagggttttatactagctgttgtttcccctctaaaagttgaaagaaaaatgacttttggaggggaatttggctaggcatagtagacaaaaaaagggcatagcaaccattttgtctactatgcctaaaatcattaagcgtttttaccttgatgctcttttgccgctttcacaaatccttcaaataacggatgtccgtcacgtggagtagaagtaaattctgggtggaattgtgctgcgataaaccaagggtggtttggcacttcgatgatttcgactaatttacgatctgccgataaaccgctcactttcaagcctgctgcttcaatttgtggaagtaatgtattgtttacttcatagcggtgacgatgacgttcaacgatcgtttcagtcccatacacttcgcgtgcttttgtgccttcgattaagtggcattgctgagcacctaaacgcattgtgccgcctaaatctgattcatctgagcgagtctcaacattccctgattcatcttgccattcggtaattaaacccacgacaggttgtcgacagtgtttatcaaattctgatgagttcgcttgagttaaacctgcaacattacgagcatattcaattaatgcaatctgcatacctaaacaaatacccaagtatggaattttattttcacgagcatactgtgcggtacggattttcccttccacaccacgatagccaaaaccgccagggactaaaatcgcatcaaccccttgtaacacttcaacacctttggtttctacatcttgtgaatcaatatatttaatgttcaccgttaaacgatttttcaagcctgcgtgttttaatgcttcattgaccgatttgtaagcatctggtaactcaacatatttaccgaccataccgatagtcacttcacccgttgggtttgcttgttggtacagcacttgttcccattcagataaatctgcttctttgcaagttaagcggaagcgatcacaaatgaaatcgtctaaaccttgcgattttaataacgctggaatacggtagatggaatcaacatctttgagagaaataaccgcacgctcaggcacgttacagaataaagcgatttttgctcgctcatttgctgggatcatacgatctgaacggcagatcaacacatcaggttgaataccgatagaaagcaactctttcactgagtgctgtgttggcttagttttcacttcacctgccgttgggatatatggcacaagggttaagtgcataaacaatgttttttcacgccccacatcaacggctaattgacgtaatgcttctaagaacggcagtgattcaatatcgcctacagtgccacccacttcaacgattgcaacatcgtgacctttaccaccttcaatcactcgtgctttgatttcgttcgtaatatgtggaataacttggatcgtcgcacctaaatagtctccacgacgctctttacgcaaaacttctgagtagatcttaccgcttgtaaagttgttcgctttggtcattttggtacggataaaacgctcatagtgacctaagtctaaatccgtttctgcaccgtcttgagttacgaacacttcaccgtgttgcgttggactcattgtacctggatcgacattgatataaggatcgagcttcataatagtgacatctaagccacgagcttcaagaattgatgccaacgacgcagccgcaatgccttttcctaaagaagaaacaacgccacccgtcacgaaaatataattcgttgccatattgtctgccttttatgtgataaatagagctgaaattcggaatggaataaaccatcaggacgggagcgtagtttacagcaaaacgtcctgataggctagtaagaaattatttataaagaaatatcccgtcttcctacaaatgaatgagaaaggcttgttccgtcaaccatttctaattcacttccgacaggaataccgtgtgcaatacgagtaactttaatattgtgaatagaacacatctcagcgatataatttgcggtcgcatccccctcaatcgttggattggttgccagaatcacttcttgaaaagattcttcttctaagcgtttctgtaataaatctaaaccaatttcacgaggtcctattccatctaaaggagatagatgtcccattaatacgaaataacgccctgaaaattgcccagtttgttcaatcgcttgaatatctgcaggcatttcaaccacacaaagttgtccgctgatttggcggcggtagttttggcagatagcacactcatcttcttcagtaaaagttcggcaagatttgcaatgtccaatgtgagtcattgcttcgctcaatgctttagctaaattcacaccgcctgagcggttacgctgtaaaagatgatacgccatacgttgtgcagattttgggccgactccaggcaatacacgcagggcttccataagattttcaagtaaagggctactttgcataagtgatatgatataaatagtagcaggggcaatttgcccctacttttaaactgattaactagataattagaatgggaacttcattcctggtggtaattgcatacccgcagtaacacttgccattttctctttttgcatttcatcagcacggcgaaccgcgtcgttgaatgcagcagcaactaaatcttccaccatttctttatcatcttccattaacgatggatcgatttcgatacgacgacaattatgcgcaccattaattgtcaccttcaccaagccagctcctgattcgccagttacttctaattgtgcaatctcttcttgcattttttgcatacgctcttgcatttgctgagcttgtttcattaagccgcccaagccaccttttccaaacatgttatgaccccattagatattaataaaagaataattaacattctactgaagcagtttagtcggcgcaagtgataaaattggctctcagctttctattgttttaatagcttagtatggatagaatccagcaacttctctaaaacttttctaaaaatcattatgtttaaactcaaatctgccttaattagaccagtacaacgtattaataacgccaaactgacttttgatgaaacaatagttgttttagttaataaaccttacggggtcctatctcaatttactaacaatcaggcatgcaaaaccctgaaagaatttatttctattccaaatgtctatcctattggacgtttagataaagatagcgaaggtctattattactgactaataatggtcaaattcaacatcgtttagcaaaccctaagtttgaaaaagaaaaaacatattgggttcagattgagggcattcctcaaccagaagatcttaatagattagctagtggtgtaatattaaaggatggcttaacaaagccagctaaagttaaaattatcccagatcctcattttaaatggcaaagtgcccccaaaattcgagaaagaaaaaatattcctacctcatggattgaattaaaaattgttgagggtaaaaatcgccaagtaaggagaatgactgctcatatcggatttccaacattaagattagttagggttggagtcagttacttcaaactaggttctctggctcctggagaatatttaattttagatgatattcaaaagaagctcttatttacaaaattaaaattgagagcagtaaatcattaaattttaattaaaatttgtattatatcagaatataatcaacaaaaattcatgacaaggataacatatggcaattttagtaacaggcggagctggctatatcggctcacataccgtagtagaattattaaatcaaggcaaagagattgtggtattagataacttatctaattcatctgaaatctctttagagcgtgttaagcagatcacaggaaaatccgttcgcttttatcaaggcgatattttagatcgtgaaatgttacgtcgcattttcgcagaaaatcagattgactctgttattcactttgcaggcttgaaagccgtaggcgaaagtgttcgagagccgttgcgttactaccaaaacaatgtaacaggttcaattgtgttagttgaagagatgttaaaagcaaatgtcaatacgattgtgtttagctcatcagcaacggtttatggcgatccaaaagagatcccgattactgaatcttgtgaagtgggtggaacaactaacccttatggcacatcaaaatatatggtagaatgtatcctggaagatacagcgaaagccttcccacaatttagtgcggttgtattacgctatttcaatcctgttggagcgcacgcaagcggtctgattggcgaagatcctaacggtattccaaataacttattaccttatatcagccaagttgccgtaggcaaattgcaacaactgtctgtgtttggttgtgattatgaaacccacgacggcactggcgtgcgtgattatattcacgttgttgatctggcaattgggcatttaaaagcgttggaaaaacatcaagatgatgcaggtttccacgtctataatttaggtacaggcactggctattctgtgttagatatggtgaacgcctttgaacaagcaaacgacattaaagtgccttataaattggttgatcgtcgccctggcgatattgcggtctgttactctaatccacaaaaagcccttgaacagctaggttggaaaacgcaatacgatttaacgcaaatgatgaaagacacttggaattggcaaaaaaataatccaaatggatataaggggtaaaaatgagcgagcaagtacaggtttctctctggcggcaaattttcagttacaaaatgttactctgcgtctttacagggtttacatctggcttgccgttatattttatctatcaattaattccagcgtggcttcgctctgaacaggtagatttaagaaccattggtttttttgctatcgtgggtttgccttacacttggaaatttttagtggcaccgctgtttgaccgctattacctaaatttccttggtcgtcgccgtagttggatgtttttcacacagatagtcttgttgggattaattgcttgctttggtttcttcaatccagcacaagatattaaacctgtaatgatgctagccattgcagttgcctttgtgtctgctgtgcaagatattgtggtcgatgcttatcgccgtgagattttgtctgatgaagaactgggtttaggtaactccattcatatcaacggctatcgtattgcagggttaattccaggtggattagcgttgattgtttctgaccactatccttgggagacggtctttttgtttaccgcactctttatgatcccagggattattctgagtttatttttagctaaagagccaaaaattttacaagataaccgcaatcttcctttccacgaagcctttgttattccatttaaagagttcttccaacgtaaaggtttatgggctgcgattggtacactcacttttatgttgctctataacttaggtgactcctttgcggctactttacaaagtgcctttattctggatatgggctttagtcgtactgatttaggcaccgcagtcaaaatcaatgggctatgggcttctattgtggcaggtatggttggtggtgtgttgatgttgcgtattggcgtaaaccgatctttatggattttcggcgtattccaaatgctaatgctacttggttttgcgtggcttgcaagtcacggtaagtttgaaaccataggcacttacgaacgctttgctttatctgcggtcattattggtgaatatatcggaattggcttaggcactgcttgctttgttgcctatatttctcgtgaaacaaaccctctttatactgcaacacaatttgcgatttttaccagtttaaccgcgattccaagtaaattgattggtgcgacatcaggggcattggcagagagtgttggtttctaccatttctattggatatgcttctttttagcaattccaggaatgttgtgcttgttttgggtagcgccttggaatgaaaagaaatagtacccagttaacatattgtaaaatataatctcgttacttaattcatactaggcgctttaagcagttactgttattattacaggcggtgttttttatattatagaggaattttttatgaaccaactagatgctttacgtcaaatgactgttgtagttgcggatactggtgatattgatgcaatcaaagcgtatcaaccagaagatgcaacaacaaacccatcattaattttaagtgcttctgcactacctcaatatgctccattaattgatgaagcgattgcttatgcaaaaacaaaaagcaacgataaagcacagcaactgattgatgcggaagataaattagcggtaaatatcggtttagaaattttaaaagtggtgaaaggtcgcatttcaacagaagtggatgctcgctactcttacgatactgaaaaaacgatcgcaaaagcacgcaaattaattgctttatataatgaagcaggtatcagcaacgaccgtattttaattaaaattgcttcaacttggcagggtatcaaagcggctgagcagttagaaaaagaagggattaactgtaacttaacactattattctcacaagctcaagcgcgtgcttgtgcggaagctggcgtttacttaatttcgccattcgtaggtcgtatccttgactggtacaaagcaaattctgataagaaagagtatgcaccggcagaagatccaggcgtggtttcagtaacttcaatctataactactacaaacaacacggttataacacagtggtaatgggtgcaagtttccgtaacgcaggcgaaatcacagaattagccggttgcgaccgcttgacgattgcaccagcattattaaaagagttacaagaaagcgaagcacctttagtgcgtaaattagagtacaaaggtgaggtgaaagctcgtccagcaccaatgactgaagctgaattctattgggaacataaccaagatgcgatggcagttgaaaaattagcggaaggtatccgtaaatttgcgattgaccaagagaaattagaagcaatgcttttagcgaagttctaattattctttagattaacagccccgaaatatcatcggggcttttatttgattcgatatgacaaatatggttctctccaattatctgataggggaaaatggtggggcaatcatattcctacgattttcgttccaatgaaaaccgataacctaagatacactaaaatgagaaaacagtgaggagcgataaaataggctatatgagtttatatcttttacaaaatttaacaacaacaaaattattaacaaatagagctattatctctataaagatttccctctctatcgttgccagctctatacaacttctgtataatcttcacccttttacaagttcaggattttgcaaaatttggagtaaacaatggctcgtgtaaccgttcaagatgcagtagagaaaattggtaaccgctttgatttgattttaacggcagcacgccgtgcaagacagcttcaacttcacactcgtgagccgcttgtggctgaagagggcgataaaccaacagttatcgcattgcgtgaaattgaagaaggtttgattaataatcaaattatggatcaacaagagaaatttgatgcaatcgcacaagaagtggcagagaaagaagctatttcattcttggctgatgtgcaagcaaattcataattagatcaaattttgttaaaaatggacaatcaaaagggtaatttgcccttttcattgtccatttttcgttatacattacgaaatctcagtttttgttgtgtgaggtgtaaagtgcagttatttgaaagtcttaataccattattcaaggttatttacctgcggatcaaattgatattgtgaagcgggcatttgttgtggctcgtgatgcacacgaggggcaattccgttcaagtggcgaaccttacattactcaccctgtcgctgtggcgtgtattatcgccgagatgaaactcgatcacgaagcggtaatggcggcacttctacacgatgtaattgaagatacaccttacaccgaagaacagcttgccgcagagtttggcacaagcaccgcagaaattgtgcaaggtgtatcaaaactggataaattaaagttccgtactcgccaagaagcacaggtagaaaacttccgaaaaatgatcttggcgatgaccaaagatgtgcgagttgtattgattaaactggctgaccgtacccacaatatgcaaacccttggggcattgcgtccagataaacgccaacgtattgcgaaagaaactattgaaatctatacgccgttggctcaccgtttaggcattgaacatatcaaaaatgaattggaagatctctgtttagaagcaatgtatccttatcgttataaggtgttaaaagcagcagtcgatatggctagaggaagccgtcaagggctgattgaacaaatttcaaaggaaattcaaattcgccttgatgaagtagggattaaagcccgtgtgtatggtaaggaacgccatctctattatctttatggacgtatgctgcaaaaagtacaacgttttaattctattttggatatttattctttccgagttgttgtagatagtgtggataattgctatcgagtattagggcagatgcatagtctatataaacctcgtcctttccaactaaaagactatattgcggttcctaaaacaaatggctatcaatctttacatacttcaatgattggtcctaaaggtgtacctgttgatgtattaattcgtactgaagagatggatcaagcagctcgttttggtgttgctgcatattggggctatcaagaacaagctaatatgagtgttcaactcagaacgcaacaatggctaaaaagtattgtggaaatgcaacaaaatgtaggaaattcggcagagtttatcgaaaacgttaaatctgatctgttttcaagcgacatttatgtctttactccgaaaggtcgtatcgtacagcttccagccaatgcgactgcagtggattttgcctatgcggtacatactgatgtgggcgaccgctgtattggtgcagtggtcgatcatcagccgtatccactttctcagccgttacaatcagggcaaaccattgaaattcaaacggcagaaagtccacggttaaatgcattgtggctgaactttgttgtcacggcaaaagcacgctcttgtattcgtaacaccttaaaaaaccagcaacgtacacaggcaatttctcttggaagacgacaattattgctctcacttaatacctctaattttgaacatcttgatcccgttgtaattgaggcactgctaacagatctacaattatccaattttgatgacctattagccgaaatcggtttgggtaatcaaattagtggagtgattgctcaacgcttatctagtaagaccttagaaattgatacagacggtaatcctgaaaataatcaatctcttgcaattcaaggcgtagatagcggtttgattagctttgcgaaatgctgtttacctgtccctggtgatgaaattattgcgcatatcagttcgggcaaagggctaatggttcactgcttaacgtgccgcaatgtgaaagaagctgcgacggatcaccgtcactatatgccggtaagctgggaaattgctaaagataaatccgttgaatttgaagcagaaatcgtggttgatattctcaaccaacaaggcattctagcagggattacttctacgattgccaaaatgaacagcaatatccttgatattcacagccaacagcgagaaggtggtgtgtatcaagtgaaattattggtcagcgtgaaagacagaacacatcttaccgagattttaactaaacttagtcatcttgttggggttgtcaaggcagttagagcaatggcctaacttcaatctaagcaatatcctcacgagttaatacaagcggatatattcctgcctgttcttgcttaagatggtggactaatgcggtgatttgttggcaaatattgcctgtcaccgcattggcttgagccattttctcttctgttacattttcagggtgtttattaaagagaactgcgtcaagcaaacgttctgcgtgcataccgtcacggcagtaatgtaatatgcccacttcagtaaatgccgttgcgacatagctgattttggtcgttgcaatgcctaaagcaccatcttcaccgcccagttccctaaatagttgatattgtggaaaaccgccacaagcaaggaggaatgcacggcgaaagaccacatttccaccacaggtcattcgcatatgttgccacgcatactcaaaattagggtgagaagcatagcgttctgcaataccaacaggctttaaggcaaggcgaactaccattgcttcaggacggaaatggaaaattgcttcggcaacttgcaatgccccattttcataagcatcatcggcatcaagaaaagcgataacctctgcatcactttgtaacgcccccaatttcgagcctttgcaacaccgctatttcgaggcatctgttcaactctaatcttatgtggaacttgtgcttcaaactgtttggcaagggcaaaggtgttatcggtagaagcatcatcaatgatccataatgtgcctaattcagcttggttaagcacactttgtactgcttgttgaagggtctgttctgcgttatagcacgggataatcacatcgatcatttaacgttcctcattaaaagcaaaaccttgaggtgatacagataaaatagatgcagttttcccccaatcgccaaggactatgcgagtgaatgtgcggtcagattttgcaaaatttttactaaaatgcaccgcttgtctgtgagtatgtccgtgaataagccattcagcgtgatagttatccacaacttgagcagtaaattcaggattgacgtccataatttcagccgacttttgttgtttgtctgcacggcttttagctcggattttttgagcgatatgaatacgcaggttgagtggtaagcagagaaatagccattgtcgccatttttgatgaactttttggcggaattgttgatatttaatatcatcaatacaaagagtatcaccgtgacaaattaaggtttttttaccatataaatcaatcagttgataatcaggtaataaggtcattcctgtggctttagcaaaagctttaccaatcagaaagtcacgattgccgtgaataaagtagcacggaatgccttgatctgtaagctgacgaatggcgtgtttcactttatcaattaaaggcgattgctcatcgtcaccaatccaaaaatcaaacagatcccctaagatatacactgcttcagcaagcggtgctttttctgtcataaattgcaaaaacagatcagtaacttcaggttgagattcgttgagatgaagatcggcgataaagtaggtggtcattgcgataattcattggggacaccaagcgtggtgtccctacaagatgtaaaaataaggtgaattgaagaatggtagggacgccacgcttggcgtccttattcattatttactactatcaaaccacccacgaataaactgcacagacaagaagaacgtcaatgcaaagaaagcatataaaatatagcttacccacggttttgatacggtttcgctttcagcaagtggtttaattgacacgatatttctaaattcattcaaccaattaattcgccagccgtagtatttaatttgtaccatctgtttttcgttcgcataggcttgtgcttttgcttgaatatcggcagagccaaatttgaaatagagcggtaatccccagcctgtatcttcattacgatacaccattaccgctttggtatcagggtgttcggtgaaaagaaaatacacatcacgcacttcgccatctgctggatttgatttgctgattaccccatctttatccatacgacgtacttccattcctgtaaccattgtttgttcatagctaggaaatgcatagttgactgcaccgactaatacaatgtgtaacgagagtgaaactaaaattagaaagtatttaaacattgctctcataaaaaatccttatccgaaagttcggcattaatataaccattaaattttaaacaattttcgcacgttttgcgtagtaatgttagcaaattcttctaaagatacgccttttagtgttgccacatattcacatacttctcgaacataagccggctggttaggtttaccacgataagggatcggggctagatacggagagtcggtttcgactaacagacgatcaagcggtactttccgcaccacatctcgcaattcttcagcattacggaaagtaataatccctgaaatcgagatataaaaaccaatatccaacgcacgctttgccattgcccaatcttccgtaaagcagtgcaatacaccaccacactgctcggcattcccttgttctaaaaactgcattgtatcttcacgagcagaacgggtatggatcactaacggtttctgcacctgtttggcaacttcgatatgttgctcaaacaacgattgttgtagtgctttggtttcgggcgtgtagtgataatctaaccccgtttcccccacagcaacaactctaggatcttgcaccaatgccaccagtttatcatagtcaaacggttcatcttccacgttcaacggatgaacaccacaagagagggccacttcactacgatgagcagtgagttgcttcatcgcttcaaagcgaccaagtgtcgtacaaatcgagatcatctgctgtacgccacgcgctttggcattgtcgatcacttcgtccacatttttatggcgagtttcatagtctaacgagtctaagtgacaatgtgagtcaataataaataaattgttcaaggttattcctttgttatttccaataagataaagggtaatataaaagtttgtcgttatctgcataagataaaaatccatatttttgataaaaagcagtggcatttttatctttagcatctacgactatcgcataagcagcaatatcagcattgactactcgtaatatagcatcaactaacagaaatcttcccagccctttgccaatataccttttatctaatgctaaacgaccaagccgaatgacaggaacgctaggataacgggggagttttttctgtttctcaactggaagatcttttagtgaaatgctagaagcagcgagagtatagtaacctactatagtttgattttcaggatcaattaacacaaagcaatttgttactcgtcttttgatgtcttgagaaacttgcgtataaaaatagctatttagctcttcagaagaagagctaaaggtgtttcttggaatagtcaaatccgaaaatcgaataaaagagagttttgcaatatccatctattttttaccaaagatagcttggtaatcttgcattgccttgagcatattttcgtttggttgatgtggctcaagtaatgcgtctgccaaacgatgttgatcttcaagtgataaatgaatgatttccgaatcggcaatcaccttacgagcggcagcttgtaaatttgtgatcataaaatcggtgagcgttatcccttcaatttctgcagcacgtttaattaaggcgtaagtatctggttttactcgagcagctagacggctcgttgccattgttgtcataaaatccccctgttgtttgaaattgtacatcagttagacgtacaaaatcaattttacgccctttccaccccaaatgccatcacttgatcgatattgtcagcattcatcgcaatcatcattaaacgatccacccccaaggcgacgccagagcagtttggcataccagcttttaacgcttcaaggaaacgactgtctaattgctgtggcggtaaacccatcgattcacgcaacacattatcttgttcaaaacggcgaatttgctctttggcatcactgagttcgtgaaagccgttagcaagttctaaccctttgtaataaaactcaaagcgttcagccacgcggtgatcttccgtactgatttgagcaagtgccgcttgagttgcagggaagtgataaactgccgttggacgctctttgccaatattcgcttcgaccacttcgctaaataaaaattgcagtaaagtatcacgctgttcatcttcatcacattgcaaaccgtgttcacgcgctttagccacaagctgggctttggttgcagagagtggatctaagccaacgtaggtctgaaatacaaattgataactaaaggattcagcaggctcacaatctaaaatctgttgtagcagatcgtccacttcattaatcaaacggtacatatcaaaatgagggcgataccactctaacatcgtaaattcagggttatggcgtttgctgacttcttcattgcgaaacactcgacagagctgaaaaatcgccccactaccgcaggcaagcaggcgtttcatatgatattcagggctagtaatcaagtgtaaggttttcgcttggcttgaaaacggcgataaaaactgagtgctaaaggttgaaagatgtacgtccgtcacggaaaactcactcatcgcaggtgtttcaacttccaataccccacgctccgtaaaaaattgacggatctccgccataattttggctcgtttcaataagtgttgaatagaggctgatggtttccagtcaggttgttcttgcaaattttccatgaaattgtaccgcttgtaataaaagtgggacattatagcagagtaagtagagcgtgttgatctcctaagcccaaaaaacaaacgacatagaaatttggtataatttagttcgccaaaacctaaccatcccatacaaactatgtcgcttagaaccattttaacagataatctttggaaacgcctagcctatttactcgaccgtacaggacgtgtttataataaacctgaacatcgtaatacagtggaagggattttatatcgtattcgtaagggatgcccttggcgtgatttacctgctgaatttggcttgtggaacacgatttatcgtcggttcaatctttggtctaaaaagggtgtttggcaagaagtgctaaaatcatttagacaacatattgattctgaatggatttttattaatcgcagtgtcatcaaggctcaccagcattcaacaggcgcaagcggtcaaaatccgcaagcgattggtaaaagtgtggcaggtaatagcacaaaaattcatttagcggtagatagttgtagaaatcctattgattttgttctgacgggggggaagttcacgacagtaaagctgcgtctgagcttgaggtattgttacctgacagtgagaccattgttgcagacagaggttatgattgtgaagccttccgagcacttattttgacaacaaaagcagttccagttatacctcgcagacgaaattcaaaggtgggtaatcaggatatagactggtatttatatcgttattgccatttagttgaaaatgcgtttgcttttttaaaacaataccgagccattgcgactcggtacgataagttagcaagaaattatgcggcatcgctagcaatgatttgttgtattctctgggggagattgttgtttggttaagatttaaactcaaaagatcaacagcccctagatgtttgaatttgactatctctaaataagccgtatatcagggcgaataaagattcgcccctcatatgattattcaatcacaatacaatctcggtttttttcaagtgtcgctttcccgatacctgaaacttcggtgagctgctcaacatttaaaaacttaccgtttttctcacgatattccacaattgcctgagcctttttcgctccaataccgactaacttatcttggatttctgaggctgtcgcagtattgatatttacaacattcgcatttactttttgtgtcgctgcgacttgttgcatcactaccggtgtatgttctgttgacgtagttactttttcttcagcaaatgttgttgcagagaaaagcccaaataaaagactgaatgtgtaacgagaaagttttttcataaattactccttaaaggttggtttaaattgcacgcataccttacaaatcaaacaaacagtctgcaatgagtaaaaatgtgtttttcgacgcagatcgaaaaaattgaaaaatcttctagacaatactgctatttttttgttttagtaaaaagttagcaaaaatagccagcttattgtgaaatttttctgaaaatccatcagaaatcctttagaataatacaatttttccttaaacttaatcatttgggatactcaaaatgagccaacaaaatttacgtaaagaacctgtttttggtgagcctagcgcagtaaaaacagagaacgaaaattcggaaagcaaattaactctctcagcacataaacttactaagaaggttaatttttcattacattcaactaaatcgccaggacacacttttactccagtaatgaagcgtcctgtaggtggtactttttcttttgcttcaatggaagaacaaaaaaatcaacaagattcaaaagagcgtacattggagcaacaaaaaacatctgcatttatgttttctcctgttgtcaccacaacagaggagccactatctgaagcaccccaaaaggaaacagaaacaacaaatgccgagcaaccagcaatgactactcaaactatagagagaattctgcctagttctcaacctaattttcaaaaatcaatcgcagaaaaggtaccatttcaatctcgccgattacttcttgtgggggtattggtattggcatcacttttgattcttttcttgttaaaaccaaatacaccggaaacactggaacaattggaacaagataatactctacctattgaattccgcccagttgatgaagcagaagcgaagcgagcagaagaagcaaaagcattaactatcccacaagcttccccgatatctccccccgtaaacaccgtagaaacaatactgccattaacaacgggaggttcgacagtttcatctaacgttgaaaatgcttctattatgcctatttctgtaacaagtacagaaattacaaagcctactgaggaagtcgtaacaaaaccaacaagtagcggaagtgtgagctaccagatggaagaagaaaaatcagaagtagagaaaattcaagctgagaaaactcaagtagaaaaaattaaaccagtttctgctgtaactcaaaaagcagaagtcaacatagaaaaagaacagcctgctaaaacaaaagtggtagtcgtaactgctaaacctgttgttacatcagcttcatctggctttatttcaagcaagacattaacgattccaaaaggtgtatctttaatgcaggttttccgtgacaatcatctaaatatttcagatgtaaacgctatgagcaaagcaaacaaagcggtcagcaatctcaaagtcggagaaaaagtaactgttcgattagacaaaaatagccgtgttgttgaaatgagaataaatgctggaatttatactcgccaatcaaatggtacttatatttttaaataataaatattgaggcaataatatcatcattgcctctctctatatttaaaaggagatacgagatgatatccataatagtgaggaagtattcttcaatatatgcaatgatagcattgctctctgcttgtatggtacctgctgtatcacctgtttctcaacttgaaaagtcattaataccaacaaaaaatacccaaatgattgttaaaattaatgaacgtatttattacgaatatctatgtgataataaacaaatcgttagggtgcagtatgacaatacaaagaaaaatagagctgttgatattactttccagcaaagtatccatacgctttattcaagtgtgacgaaaaaaagcaaaaaatacagcaatatccgctggatatggtcagaagattttgatggcaaaggcacattgcgagataaccgcaataaaatccttgccgaaaactgcgtgaagcaataggaagcataatgaatattttagttattgcaccttcttgggttggggatatgataatgtcccacgccctttatcaacagctcaaaaccaactatccgaattgccaaattgatgtgatggcacccgactggtgtcgccaattactttctcgtatgccagaagttcgcaaagcgatttcaatgccaatcggtcacggctcgtttgcgttatgtaagcggtacaatttaggcaaaaatttgcgaaatcaatacgatatggcaatcgttctgcctaattcattgaaatctgcttttataccgctatttgctaaaattccgcaacgtcgtggctggaaaggggaaatgcgttatggctttctcaacgatttacgcacgaataaaaacgactatccgatgatggtacaacgttatgtggcacttgcgtttgagcaaggtaaaatcccgacagcagaaaacttaccgattgcttatccttacttacaagtcgatagcgagcaaattgcacaaaccaaacaacattttgctaaacagtttgaatatgccgaaaaccgtgaagcaattggtttctgcccaggtgcagagtttgggcctgcgaaacgttatccccattaccactacgcaacactggctcaaaaactgattgaacaaggctattccatacgtttatttggttcgaaaaaagatgaagaagtcggagagcaaattcgcaatagcttgcctgaaaccttacaacgctactgcatcaaccttgcaggacaaacggatttaaaccaagctgttgattttattgctgattgcaaagccattgtcagcaacgactctggactaatgcacattaccgctgcccttaaccgaccgcttgttgcgctctatggtccaactagcccacaatatacgccaccgctctctaaatctgcagtgattatccgcttgattgaaggtggtttaattaagatccgcaaaggagaagggcaagacggttatcaccaaagtttgatcgatattcagcctgaaatggtactggacaagttaaataataagctgtcaaaaaaaagttcactttaattcttttcatagacgttttttattttatttccctagctatttagataaaataatcgtcgtttattaggtataatcgtttgaccttcggagttgcaatgaaaaatattttagtgataaagtcaagtattcttgcggataaatcaaaatctaatcaattggttgatcacttcaagtctcaaatttcagctaatattatagaacacaacttaggtgaaaatccgctcccgtattatgatataaatgctgtattagatatacgaggaaaatcacaagatgatactcaatataatgctctgactctttctaataatctgatcaatgaagtaaatcaatgcgatctcattgtatttgctgttcctatgtataatttaggtataccagcacaacttaagacatatctagactatttaacccgtattggcgtaactttccgttatacagaaaatggtcatgaaggtttaattaaaggtaaaaaagctattgttgtgcttactcacggaggagtctatagggatacgcctacagatttagccaaaatgtatatgcatgcagttcttaattttattggtatttttgacatcgagtttgtttacgcggaaggtcttggctatggagtagaaatttcagataaagctcttgaagcggctaaagttgaactggatcgtattgctcaaacattctaatttaatgataaaaacaccgtctaattaggcggtgtttttatatgtaaccgtttgtcttttatccatatcaaataactacgcaatatttacaaataatcatttcaatcttactgcttttcagttagtctactactgtctatttgtttatcttaactataaggaaactcactatggaaactctctttcaagtagctcaaaattggttagatcaagatcctgatttagaaactcgtgcagagttagagcaattgatttcgcaagcaaaagcaaatgatgcgaaagctcaagctgaattagctagccgttttgatggacgtttacaatttggtactgcaggcttacgcggtcgcttacaagcaggttcaatgggtatgaaccgtgtacttgttgctcaagctgcgggtggtttagcagaatttctaaaaggctatgacaaagagccatctatcgtgttaggttatgatggacgtaaaaattcagatgtgtttgctcgtgatactgcagaaattatggcagcagcaggcattaaaacttaccttcttccaagaaaattaccaacgccagtgcttgcctatgcaatcaagtactttgacactaccgcaggtgtaatggtaacagcaagccataacccacctgaagataacggctataaagtttacttaggtaaagcaaacggcggtggtcaaattgtatcgccagcagaccaagaaattgcggcttgtattgataaagtagctcaaggcagtatcaaagacttaccacgtagccaaaattacactgtattagatgatgaaattgttgatgcctatattgcaaaaacggcaagccttgctaaagagccacaagttgatattaactatgtttatacggcaatgcacggcgtaggttatgaagtattgagcaaaacattagccaaagcaggtttaccgcagccatctatcgttgctgaacaagtatggccggatggcacattcccaacagtaaacttcccgaacccggaagagaaaggtgcattagatttagcaattaaagtagctaaagagagaaatgcggaatttattattgcgaacgacccagatgcagaccgtttggcagtggcagtaccagatgcacaaggtaactggaaacctttacatggcaatgttatcggttgtttcttaggttggtatttagcaaaacaatatcacgcacaaggcaaaaaaggtattttagcttgttcacttgtttcttccccagcacttgcagaaattgcgaagaaatatggctttgagtcagaagaaacattaacgggcttcaaatatatcggtaaagtaaacggcttattattcggttttgaagaagcattaggctacttagttgatccagataaagtgcgtgataaagacggtatctctgcagcgattatgttcttagatcttgtgcgtaacttgaaaaaacaaggtaaaaccttagcagattacgcagatgactttaccagagagtttggggcttatgtaagcggtcagatctctatccgtgttgatgatttatctgcaatcggtaaattaatgaccgcattacgcactaacccaccaagcgaagtgggtggtttcaaagtagcgactttcttagatcatacgaaaacagatcgccaaagcgacattttagtctttgtgcttgaaaatggcagtcgcttaatcgctcgtccatcaggtacagaaccgaaaatcaagttctacttagatgctcgtggaactgatccgaaaaatgcagaagaagtgttagcacagtttgatgcaagcgtgcgtgcaattcttcgtcaagagcagtatggtaaacaaggttgctagttgattaaaatgttaaagccagatagatagtaaaaagtgttggttttagtttttctattaccgacactttttatatttccgtttaatattcattaatcacctatcaaatgtaatttttattaagaaaatgatgaacaataaattcaatcctaacccccctagttttaagtcagtaaaagcatgccaacctcttaaatttaaaacgaaaaaatcttcactacaacaagattatgttcaaacatcaaaaaatgagcactacaaagacaaaccaagtttatcgatttatacaactgaagctaacaaatctagtaaagaaggctttgtaaaagtcagtgtaaaagacagaaataaacctataaaaagtaaaagtggtgccctatctccaagagtaccagaaaaaatccgtaataatcgagccagtgaaatgaaagtttatggagaacatgcttgttctactatttttcaacaacgccctgaagctatcgttcgtttatggattacctctgagtgtgccaaaaaaacaggagcgttattaagctatcttgcagatcataaaaaggcatatcatttagtagatactgaagaaatgctgagagttacaggaacagagcatcacggtggtatgtgtttattagtaaaaaaatctacaccattctcgttagaaggctatttacaactggaacgacaacatgattgcttaatactattagatggtgtaaataatgctcaaaatatagggggaattatacgcacttgtgccttttatggaataaaaggcattattgtagaaaataatgacatactgaattcaagtaatgctgctcgtgttgctgaaggcggtctagaatttgtgtatcccttagagacaaaacataaacacattgccttaatgcagttacgtaaggctggttatcaaattgtgcatttaactcgccaaaggcaagcgccacatttatctagaatagtattatctaaaaagattgtatttgttttaagtgaagttatatcaaatgaagttgaatatcctgaagatagtattgttcagctctcatttgctaattctctcaatagtgggctgaatgtggctgtaaatgcagggattttattagcgcaatggtatcaaaatcatatgttatagcgactaaatgattttactctaaagatagtcagagatgattatttatacttatgttgagtctaagcattaattatgtctatttgttcacataaaccttgcacttttctgatcggaacagaccgcttttttgcattctttttttgatacgacggagccattgaggtaaaatcctgccttattttgtaacgaaaagataacgataatgacaacgcaactttccttagagcaaattttaactctcgtcaaagcagatatgcaggcagtcgatcaggctattcttgctcaaattaattcagaggttgttctgattaatcaacttggacattacattattagcggtggcggtaagcgtattcgcccgttgattgcagtattggctgcaaatgcggttggctataaaggtcaagagcatattacctgtgcggcttttgttgagtttattcatacggcaaccttgctacacgatgatgtcgttgatgagtcggatatgcgtcgtgggtgtgaaacggcaaatgcccgttttggtaatgcggcaagtgtgcttgtgggtgattttatctatacccgagcgttccaaatgatggcaagtctgtgttctcttgatgtgttacaagtgatgtctgatgccactaatgtgattgccgaaggcgaagttcagcaattaatgaacgtcaataatcctgaaactaccgaagcaaattatatgcaggtgatttacagtaaaaccgctcgtctgtttgaagcggcaagtcaatgttctgcgattgtttcaggtgcggatcaagcgactgtgattgcgatgcgtgattatggtcgttatcttggtacggcattccaactggttgatgatattttagattacagtgcaaatgctgaacaattaggcaaaaatatcggtgatgatttagccgaaggtaaaccaaccttgccattgctacacgcaatgcgaagcggtaatctgcaacaagcagcattaatccgtgaagcgattgaacagggcggaaaacgtgaagccctagacgagattttagcgattatggcggagcataaatccttagattacacaatggaacgagcaaaacaggaagcacaaaaagctgttgatgcactcgccattttgccagaaagtgaatataaacaagcgttgatctcattggcgtatttgtcggtggatcgctcttattaaacaattttgtagggacacactgcgtgtgtccgcaaaataaaccatatctcatttttacaacggacacacgcagtgtgtccctacgttttatatattaacaatgacagaacaaaccaaccaaccccaagaacacaaagaagcgttacaacaaaaacgcaaattaacccgtaaaggcaaagatccgaatgctccttttgtgcgtgagaaactagaattgccaaatggacacaacaagctcttattacactcttgctgcgcgccttgttcaggtgaagtaatggaagctattcacgcttcagggatcgaatttgcgatctacttctacaatccaaacattcacccactcaaagaatacttgcttcgtaaagaagagaatattcgctttgcggaaaaacacggtattccgtttattgatgtcgatgacgattatgaaaacgaccgtaaagagtggttcaagaaagcagaaggtatggagtgggagccagagcgtggtattcgttgcacaatgtgctttgatatgcgttttgagaaaaccgcaaaatatgcccatgaaaacggctaccctgttttcacgagctgtttagggatttcccgttggaaagatatgaaccaaatcaatggttgtggacaccgtgcggctgccgcttatgatgatgtggtttattgggattacaactggcgtaaaggtggcggttcacaacgtatgatcgaaatcagcaaacgtgaacgtttttaccaacaagagtattgcggttgcgtttattcattgcgtgacacgaataaatggcgtttagaaacaggtcgccagcgcattgaaatcggtaaactgtattattcacccgattaaaaagtagggacacactgcgtgtgtccatcatcaagcggttaattttcaacaaatttttacaaatttaaaagaggaacaaacaatgtctaaatttgcaatggtattcccaggacaaggttcacaagcggttggtatgcttgctgatcttgcacctgtttaccctgtggtagaacaaactttcaaacaagcaagcgatgtgcttggttatgatttatgggatttagttcaaaacggcacggcagaagatttgggtaaaactgaacgcacccagcctgcgttattggcagcttctgttgcgttatatcgcatttggcaagagaaattccctgagcaaaaaccagcggtaatgacaggacatagcttgggcgaatattcggcgttagtttgtgccggcgtgttggatttccaagatgcaatcaaattagtcgaattgcgtggtcaagcaatgcaaagtgctgtgccagcaggtactggggcgatgtttgcgattatcggcttagataacgatgcgatcatcaaagcgtgtgaacaagcagcaagtgaaatcggcgaagtggtttcagcggtaaactttaactcaccaggtcaagtggtgattgcaggcacaaaagcagcggcagagcgtgcaggcgaattatgtaaagaagcaggcgcaaaacgtgcgttaccgttagcggtgagcgtgccttcacactgtgcgttaatgaaacctgcggcagaaaaattagcggcggcattgcaaaatattttgttaaacgcaccgcttgttccagtaattaacaacgtggacgtagccgttgaaactgatgcagataaaattcgtgatgcgttagttcgccagctttatagccctgttcgttggacagaaactgtcgaaaaaatggcacaagatggcgtaacaacactgtatgaaatcgggccaaataaagtcttaacaggcttaacaagccgtattgtgaaagagttatcggcaagagcggtaaatgatgtggcatcgtttgaggcggcggtgttttaattaaaaaattccccctttgaaaaagggggattaagggggatttaaagatctggatattttcccgtaccatttaaaatcccccctagcccccctttttcaaagggggaaatggttaaattcaattaggaaaaatatacatgcaaaacaaaatcgcattagtcacgggagcaactcgtggaattgggcgtgcaatcgctgaagaattagtgtctaaaggtgcattcgtgattggcacggcaacctcagaaaaaggggcagaggcaatctcagcttccttaggtgacaaaggcaaaggcttagtgttaaacgtggctgaccttacctcaattgagcaagtgcttgctcaaatcaaagaacagtttggcgacattgatattctcgtgaataacgcagggatcactcgtgacggtttattgatgcgtatgaaagaagatgactggttcgacattattcaaaccaacttaacatcaatctaccgtttatctaaagcggtattacgtccgatgatgaaaaaaggcggccgtattatctctatcggttcggtggtaggttcagtgggtaacccagggcaaaccaactactgtgcggcgaaagcgggtcttgttggcttctctaaatcactggctaaagaggtggcttctcgtggcgtaacggtaaacgtggttgccccaggttttatcgcaacggatatgacagacgaacttaccgaagatcaaaaaaatgcgatcttaagccaaatcccagcaggcaaacttggttcagcacaagatattgcaaaagcggtggcatttttagcttctgatgatgcagcatatatcaacggtgaaaccattcatgtgaatggcggtttatatatgaattaattatttcaaaaaataaataaaagctgaattttgtaataggcaaaattcagctttatttttatctattattgtggataataaatcccttttcaaaaataaactagagaaatacattatggttaaaaatatctttgtcatcggctttatgctgtttgcaattttcttcggggcaggtaacttaattttcccaccgaaattgggtttcgatagcggagcagatttctggactgcaattttaggctttaccttaacaggtgttggcttacctttaatcgcaactatcgttgcagcttgctacgaaggtggttataaaaaagcccttgaaaatatccacccagcgatttcgttgcttctcttagcggcaatctatttgacaatcggtccattcttcgcaattccgcgtacgggagcgaccgcttatgatatggcaattgtgccgtttgtaggtgagcctgattctacatcgctatttattttcacagctatctatttcggtttatcactttggttaagtctaaacccaagcaaaatgatcgaccgcattggttcaattttaaccccagcattattaattctaattattgccttagtgatcaaagcgatagctctattctcaggcgttgaaacagcagaagctaaaaccttagaatcacctttaacaagcggtatcttagaaggctatcaaacaatggacgcattagcagcctttgctttctctgtgttagtgatcaatggtattaaagcaaaaaatgcaaatagcaacgtatctttagttaaacaaacgacttacgcttcttttgtcgcagcaatttcattagccgttatctatatttctatcggctggatcggttataaaattccattaagtgcagaaacagtggcagacgttgctgctaaagggcaaaacttaggggtatttattttaaatgaaaccacaacccaagcctttggtgaattaggtcgtaccgtattaggtttcatcgtaactcttgcgtgtttaaccacagcgattggcttgattgtatcaacatcagcttacttcaatagcattttcccgaaaatttcataccaagtttatgcggtgattttcacgttaatcggcttcggtttagcaaaccaaggtttaaatgcggtaattagcaagtctgtacctgtattactcgtgttatacccgatttcaatgactgcattgttggtattattagtgaacttattcttcccattaccacgtttagcacaaggtttatcgattgtatttgtaacggtcatttcaatcttatctgtggcaggcgttgaatttattgctcaacttccacttaaagcctactcaatggagtggttgccatttgcacttgttggctgtgtgattggttatgtggttggtaaagtgaaaaaagattaattcatcttattttgttgtataggggcgttttcgccccttttttataaggaaaaacaatgccagaattacccgaagtcgaaacaagtatgagaggcatctcgccttaccttgtagggcagaagatcaaagagattattgttcgtcagccgaaattacgttgggctgtgagttcagagctttcaattatgcaaggggcgacgataattaagatttaccgccgagctaagtatttaattattcagacagataagggcgatattttagttcatttaggaatgtcgggatcgttgggtattttatcggtcaaagagaataaggcgatagataagcacgatcatatcgatctcatcacagaaaacggcgtaatcttacgttataacgacccacggaaatttggaacctggctttgggcagagcaagctgaaacagcagagttattagcaaatttaggaccagagcctctttcagaagcctttacaagcggttatttatttgaaaaaagtcgcaataaaacggttgctgtgaaaaacttcattatgaataacgctatcgtcgttggcgtgggcaacatctatgcttgcgaatcactttttatggctggaatccaccccgaattagccacacaaaatctaaccgcgaaacagtgtgagagattagtcactgtgattaaagaggttttgacaaaagcgattatccaaggaggaacgactttgaaagactttattcaacccgatggaaaacctggatatttcgcccaagtattacaagtctatggtcgcaaaggcgaggaatgtaacgattgtggctctattattgaagctaaggtaatcgggcaacgaaatagtttctattgtccaaagtgtcagagattaccgaagtaaatgacatagtagacaaatgtgttaatgttttacaaactatgcgtttaatcggtgttatatagcacttgctacataacactgctttttatatggcatagcaaccattttgtctactattcctccgaaaatataatgggattgatcgaaaaagtttccctttattctttaaagaatgtgaatttcgatttaactttggaacaccaaaagagcaacttaaaacgttgagaaaatggtgtggaatttagggctaatctaatacagcccctttatttattacaaccaacgagcaacattttgtttatattggcgataactctctccaaatttctgttctaaaatccgttcttccggctcgatttgaaaacgggttatataagcaataaatccccacacgacaagcaatgcgaacgtatttcctaaccaaaacgcccaagcggataatagacttgccaaccctaaatacgtcggatttcgactaaagcgataaataccttgtgttattaaagctgatgttttattgggagcaagcgggttgattgtcgtcttattttgcaaaaaagcccacaatgcacaaagatcgacaccaatcccaaatatcaaacagatgaccgcaaagctctgatatacccagttaggttctgcatagttcggtagaaaatagataattactgcacaaattagtgcaactaagggagggggaagtttgagttccattaagcttgttcccctaaaataatatgtgataacgactcatcccaactctccaacggcaaatactccaactgctgacattgatgagccaacccaacgctgattaactgtttagcttgagaaagggtgcggtcgtaaaagccgccacccattcccagccgattgccttgtgtgtcacaggcaaccagtgggacgaagatcatctctaactcattgagtggcaacacatttcgtacatctaatttcggttgcaaaatcccaaagcgatttcgttctaactgtgcttccccttgatattggagaaaaagcagttggttggctgaaaaggggtgtagcacgggaagatagatttttttgccttgtttgataagtctatccattaacgcaagcggtgagatttcaccgttaaatggcaaataaaaggcaatatgttgagcggaataacgttcaatgagttctaatgattttaggataatatcttgtgccgcaaaggcttgttcatcagcggttaaggctagacgtttggctcgcatctgcttgcgaagttgatagcgttgttcgcttatagaaagtggagaaatatcgttcataaaaaagacccgaagtgccgtcatcagttgtggtccttgaaccagacggtccaagggagtcgaacattatcgtttttaggcttctcgtaaacgagcctgctcaccaacaatataagagctcaactcaaagtgttttaaatatcggctcagggacgtaactaacaacgcacacctcaggcaaagagaatactaacggaatttgctaatttttcctagtgttcagatcaataaaatcatagaaattcgctttattcgttattttcttgaccaacagaaaccgaatccatcccactagattggaattttgcaagagaactatctagttgctctacgcacgccattaacacatttttgttttcagcatttttgcgttgttcttgttctaattcatagttgagatttaaggcaacgatcgacaacactttttcaagctgaataataccagattgctcttttagcactgcaactcgatcttctaaccgcttggctgaagccaataacgcttcttgttgttctggcgggcagtataaacgtagcacttgtccaaagagcgataattcaatgttatttttcgacattgttgagaaatccttacgaacacaaaaatttttgctattatgccaccctttgaacaaatcacaaataatctaatatggcaatttcacaatcaaacgactttaaacagctgatttctgagttacaaatcgactatacttctgctgaatttcacggttttttaagtggattaatcgctggtggtattcaagatgagtcttggaaaacattaacctatcaatttaccaatgatggacacgcattttctcaagacccacttgcaaaattaactgaattttatcaacagcttagcgagagctttgatgaaacgaatacgctcttttcattatggttaaatgaagaagatggttttgcaatggcagatggtattgctgaatggacagggcattttttacttgggttaggtttagcacagcccactttacagcaagaaaccaacgaagttggcgaagccattgatgatttagatgaaatcgctaaattaggttatagtgaagaagataaaaatgatgaattgctagacgctggcgaagaaattattgaatatctacgagttgttacactctttttacatagccatttcgccacacctaaaatggcggaaaagccaaaggttcattaatatcaggggcatacgccccttttattatgccgcttggcgatgataatgccttaacgcctgctctttttgacgggcggagctaaaagatgaaatcctttttaaataaccaattactctagtagcgtgatcgatgtctttagaaccacaacagctacattgtgaaagggggcgtttatcaatatggtcacaggcattacatagggtgattttcacattgatacaaaaatagttacagcctgtttttgccgcaatgtctaatagtgagcggtagctctgctggcttaaggcttcttctaaattcagatgtaatgccgaacctccatcgaggtattcaaccaacgcttttccgtgtaatagaaatttatctaacgcattgatttgttcatcttccaccacataaaaataagagttatagcactctctcggcacaacataacccgcttccctgtcccatttcgcatttttcacccctaaattctccgcagggacaaattcggtattaaatttcacgccgtaggttttgcaagcggtctgattggcttgataaattgcaaatagtcgctcacgcacaaaatcaatatattctgaattgtaccccaccttaatgccccgaaactctgccgcttcgaccattccgttaataccaattgtcaggaactgcttatctaatgagataaacccagcatcataaacaggtaacattccctcattgagataatcttccattagctttcggtaagcatattgatattgatggatcttaccgacttctgtcactaaatctcgttcatcttgctccaaacggttcatattgagtgtaataacattaattgagccagttgcaacaccaccagcccctaaggagtaagaaaaagagtgatcggcaatttcattgcgtaaacggcaacaagatgcaagcgaatcaggattatccgattgataaataaagaaggaatttccttcggctaaggcttttgccattttatcggcaaactcactgtctttgcatttgccattttcagtcagcattgccgctgtcacgactggaaaggttaaaatcgcttttgtccgctcttgattaaaccactgcataaagaaatcttgcaacgctgatgtggtttgccaattcggtgcggtgagatcagaaaagacaaaattgccgaacatcgcattaaaatagtaatggtcgtaaatggaaatattccaaaagacactttgataaccacgagcggcagcaggttgattaatgctatacaccacttgctgtaaatggttggcaatttcgtgttgatgtgtttgaagataattatcgccataatccttacgagcaaaatagtcaaaataggtcaaaaactcgacggttgccactgcccctgcaaattgagagctaatcgcaaagacaaggttaataaaagatccacaaaaagaggcaaggtgttgtggtgctcgagattccccacccagtttggttaaaccgtctcttaaaaaaggataaagtgttaccgatacacaataaggcttcagactggtttcatcgtgaacatagatttcgtgtgcttcaatttgacgcagatattcgtccgcaagggattgaccaaaaatctctgcaattttaccgcttactttggctcgattgatttgtacaaagaaatccttcatcaattcctgttccattgttgctaaattcttttgggtaacattagcgttagcgtccatttttgaaccgtccgccgcatttttagcgtgaatgtattggtcgataaaatttaatttgccgagtagttgcgagtgttcaagtctaatcattgtttatcctgtctaaaatgtgcatttagcacttcacctgtttgaagattaataaatcgttggtttgtggtaatacaatttaacccgccaagttcagcaatccagcgacctgttttgacatagtccaacactgctaaaatctctggtggcagttgctcaagctctagtcctgtataaagacaggtttttaagccaaactggcgagcaagctgtaaccgttgcaataactgttcaggcagccattctccccccataaataatacgcaactgatcagcccttgatattgcactaatcgctgttgtaagtaagtttctgagagaatctgaccgcttccaagtttccaactttctatgctgtggcaacctttacaacctaaaggacaacctgaaattagaaaagctaaagaggtttcattggggacttcttgccacacaatctgttctgaaataaaacggatctgtttcattatataaccactatatcttgtggctttaaaccattaaaaacacaatatgtagtagtttatgcattttaatgtaaagggaattgataaaaatcaaagtgagtgaaatcactttgataagctcaaaagaaaaggaagaaaatcaaaaggatagaaaatgtaaattttttcgtatgattaatgccccagccaatttctcaacatctgttccccgtattccgtaataaaagactcagggtgaaattgcacgccatagatcgcaagagagcgatgtttaactgccattaatacgccttgatcgcaagttgcagtagcaacaagcggtgtgttttctaatgatttttgcgaaattgcccaagaatggtataagccgatattgaattgcttcggtaaatttttaaacaatgggttggcttgttgctgaattaatgggcgttgctgtccgtggcgaacttgattaagattgtaaagttcaccgccaaaaaattcgcacaaagtttggtgtccaagacaaacccctaaaattgacttatgttggtgataacgttctagcattgcaaatagttgtggatatgctcttggtacatcaggacctggtgaaatcataatatgactaaaacgttccacatcgtctaaatctaactcttccaccgacaccacctgcatttcaaccccgattttgcgtaataaatcaacaaggttaaaagtaaaagagtcgtgattatcaataataagcaacattaaacattatcctgtgttatcggtttttcaaccagtaaatgtaaacgagtcgtatcccaatcagtttcaagcaattcaacttgtggggtagtttgctgtgcttttgcagaaagctgttggaaacgctcgactttgcctagcaatccctgtttaccgaccagtgctgttacactttggttatattgattgcttgcagtattcaaggtattacccaatttagcaagacgctctgcaatgacgcaaacctggttataaatatcccctgctttttcactgatctctcgtgcctctgcattacctcgctcaattcgccataaatttgcgactgtgcgtaaaatcggcattaatgttgtgtgagaaaccaaaatgacatcacgttcatagccataattaaagagctgtggatcgtgcttcattgcttcaatataagcaggttcaatcggtacaaacatcaacacgaaatcaggactttttatcccaatcaactggctataatttttcttagacaatccatcaatgtgagtacgaagtgaacggcagtgttcatcaagtgcttgttgaattgcaaaattatcttcggatcgtaccgcttgatcgtaggcaattaaggaaactttactgtctaaaatcaaatgcttatcgtcaggcaacttcaccacaaaatcaggagcaaagcgttttccctcttcatctcggtaactctcttgggcaatataatgttccccagccaaaagccctgctgtttgtaacgcactttctaactgaatttctccccagtttcctgcaattttattattgccttttaatgccgtagtgagattttgtgcttcctgtgacattgacagcccaatctcaagcacgcgtttgatctcagcccctaaatctgcattgccttttatcgcttcactatgcacctcattgacacgtttttggaaaccttcgatctgctctttaaaaggcttgagcagtaaatcgagtgctgactgattactctcagaaaaggatttactcttttcttccagaatttgttgggcaagatgttgaaattcaacatttaactgctgacggacttccaagaaattccgctgttgagcttcaaagtttgcctgtttttccgaaagtgtcgtgcgtaattccgttaattcttgttgtgattgggaaaatttagcctgtaactgaccgctttctgcttgctgatgttgtaactgtaactgagtttgttgtaactgttcttccaaactttccgctttagtctgagccgaaccgaaccgctcttttaattcattaatataacgctctagttggtcttcctgtaattctgcctgctcaagctgttgctgaagtttttgaatcgctaaatctcgttcatttaaacgctcaagggttgattctgcttttgtctgttgctgaacggcaaattgttctacttgatttttttcaagggaaatttgctcatatttttgcgagagcgttgaaaactgctgttgcaattgttcaagatcctgttgtcgttcttgactatctcgttgtgaacgggaatagctaaaaaagagccaaagtgagatcaataagagtaatgctatcgttgcataaagccaaattgggtcgagattcataggaatatatactgtaaaaataactagtgttattttaacgagttttgctgttaaaaagcaagggggaaaagtagagtcagaatgggacagctgtgctctatataaaaaattgctacaatagcccactattatagccttgcctatatacaagctatcgttttttacaaataggattttatatgacccaatatctttcaacttcatttccagctcaccgccctcgccgcttacgcaaacacgattttagtcgccgtctagttgctgaaaatagcttaactacgagtgatttaatttaccctgtatttatcattgaaggggaaaatcaacgtgtaagagtgccttcaatgccaggtgttgaacgtttaactttagatcaattactgattgaagcggaattattagtcaaatatggtgtgccagctatcgcacttttccctgtagttggcgatgcaaaaaaatcactgatggcagaagaagcttataatcctgacggtttggcacaacgtgcagtaagagcgttaaaacaagcctttggagaaaaattaggcgtgattacagatgtggcgcttgacccatttacgactcacggacaagacggcattattgatgaagatggttatgtggtaaacgacattacgaccgaaatcctagtgaagcaagcgctttctcacgcacaagcaggcgcagatattgtcgcaccaagtgatatgatggacggccgtattggtgcaatccgccaagcacttgaggctcacggttttatcaatactcaaattatggcgtattctgcgaaatatgcgtcaaactattatggacctttccgtgatgcagtcggctctgcgggtaacttaaaaggtggtaacaagaaaacctatcagcttgatcctgcaaatggaaatgaagggttgcacgaagtcgctcttgatattcaagaaggggcagatatggtgatggtcaagccaggtatgccttatttggatttagtttaccgtgtaaaagagacttttggtgtgccaacttttgcctaccaagtatcaggggaatatgcgatgcatatggccgcgattcaaaatggttggctcaaagaaaaagagtgtattatggagtcactgctttgttttaaacgtgcgggggcagatgggattttgacctattttgcgaagcaggtagcagagtggttgtatcaagaaaagtataaatgagctgagttacggagaacatggcgctactattccaataccttctatatggaactttaattttgaagtagaattactggacattgcccctatattgcgtttaactctgtactattatttataattgataaaatgtaaaatttttccaatctgaatattgggtagaataattaaatgaattaataaaaattctggtatgtcaggaaataaaatgcttatgaatttgctacatccaaccgatttaaaacggtgccaactcacccatcttcattccttcactaaaggaatgaccgtatataaacaaggcgaaaccgctaaagagttttattatgtcaataatggacttattgggctttatcacaccttagataacggcaaagagagtcttgttcgtctatatcaaaaaggggattatttcggttatcgaacattgtttggcgatgacggctaccattgcaatgccaaagttttggttgaagcggagatcattcggattaaaccaaaagacattgatactttcttcgtagaaaatccgaagatgagcaaatttttgttgcaatcccttgcaaatgaactgcgagaagcggaacaacgcttggcaaaaagtgcctatttacgcacccttgatcgtgttatcgacagcatttattttctcacggaaaacttcccttactataactggacgcaccgtgaaattgctgaatatgcagggtgtgaaaccgaaacagcgatccgcattactaaagagttgaaacgcaacggtttattacaagattggcataaacagaagtaggtcactatgtttgaaaacgcccccaaagcccattttcatttgatggcaaaaccgagtagctttcaatgcaacatcaaatgtgaatactgcttttatcttgaaaaagaatataccattgagcaagatgtgcgttttatgaatgaagacaccttgcgaaattatgtgcgtaattacattcaatcaagtgcaggacaacgggttgaatttgcgtggcaagggggggagccaacgttattaggcttggatttttttaaacaagcggtcagatttcagcaagaatttgcaaacggcaaaacgatcaccaatgcttttcaaaccaatggcatcgccctaaatcgccaatgggcagaatttttcaaaacacatcaatttttgattggtatttcgattgatggcttgagcgaagtacataacaaatatcgcatatcagtcaatggtcagccgacttttgaacgggtcaaacgagcggtagatttattgaaagactacggtgtggagtttaatacattgacggtgattaacgatcaaaattggcataaaggcagagaaacctaccttgctttaaaagagttgggttcaacctttatgcaatttatcccgattgtcgaaacaggctgtggcacagcaccttttgcaaaaaaggaagtaaaaccgaccgctttttctgtgccaccgcaaggttatgggcattttttgcttgaagtgtttaaagagtgggtgcaacaggatgtcggcaaaatttatgtgttggaatttgacaatctgcttgggcaatggcttggctacccgtcaagcagttgtgttcatcaagaaacctgtggcgagtcgctgattgtggaagcgaatggtgatgtctattcctgcgaccattttgtctatccagcgtataaggtgggtaatttaaatgaacagcctttgggcgagattgtgcattcccaaccacaacgcaactttggacaacaaaaaagaaccgcactcactcagccctgttgggcttgtgatgtgcgaccgttttgtcacggcggttgcccgaaacatcgaatgattagcctaccaaatgaagcaaataaacataactacctttgccaatcctaccaactctttttccgcaaaactgcttcatttatgcgaaaaatgcgagatattattcgcagtggtggatcggctggggatattgtgaattttattggcgataaagatgctaacaagaatatataacaaacattactcattggataaaaaaagaatacagccatatgacctttatgctaataaaagagttataaaaaaggtagtcctgaggtcagctgaagaaagaaaaatcttatatttatcaatgagtttctaacctttatctaaaaaagaaggtgtaatagacaaaatagttgctgattcgtcaaaaactatgccaagaggacaaaacagttgctagtgtttattttctctaaatgttagcaacacttttgtctactatgccttttaagttaactactcacaatcaccctcaagctatccaatcgccaatttgcttggtctagatgtttcagtgatgcttctcgcaactgctctagggcttgaatttcatcagcacgaatgtttttattcactgcttgtagtgatgtcaagcggtgtaattctgtacctaaagtgtgatccgcattctgttttgcttgttcaattaaggattgtgcctgtggcacaactttttcatcactgaatgcgataagcttctcaatatcaccacgagccatcttcgcaattttatttgccatctgtttattgaccggcttgagctgtttttccaaccctgcaaacgacacctgcgatgccatatcgttgcctttgttatccagcaagatacgcacaggcgttggcggtagaaaacgagtgagctgtaaatcttttggtgcttgggcttctacgatatagattgcttcaagcagtaacgtgcctgctggcaagttcttattaacgagcagtgaaatcgcactcttaccaatatcgccagaggtaatgagatcgataccgttgcggatcatcgggtgatcccacgttaagaacaacacatcttctcgcattagggcaagttcacggtcaaaagtcactgtgttgccttcttcagacaaccctgggaaatcaggcacaagcatatgtcctgtcgggctaatcacaatgcttttctcgcctaaatcttcctgctctagaccaatcacatcaaacaaattcaaggcaaaattgaccaactgaggattatcatcttgttccgcaatagcttgagctaattgttgagcagtttcaccaccgtttgaattaagctctaacagacgatctcgccctttttctaattccactttaagctgttgttggcatttatgggtttgttccacaaaggcttcgaaggcttcgctacgttcaggattgagtaggtaagcggtgagttccgcattaaattctctaaataacgttgcccccatcggacaagtttcttcaaaggcatttaagccacgatgataccattccgccaagatcaactgggtggagtgattgaaacaaggcacatagatttcaatatcgtgtttttgcccgatacggtctaaacgcccgatactctgctcgagtaagtctggattatcaggcaaattaaacagcactaaacggcgtgcaaactggaagtttcgaccttctgaaccgatacttgagctaatcagcacctgcgcgccatcttcttgttgagcaaagtaagccgacgctttatctcgttccacaatcgacattttttcgtggaaaatcgcagagcgaatggcttctttttcacgcaacacttgttctagctgaatggcggtgtctgcttgtttacaaattactagaattttttcatcacgatgatttttcaagaacgtaattaaccactcaatgcgtggatcaaactcgtgccacttcacatttgggttcatacgttggaataggcgttcagggtagagcagatcttccatcttatttccccccatcatacccattactttcaaagcatttgcatattgcgtaggcatttccaacacaatttcattgtaaatacgatgtgggaagccttttacgccttgacgagtattgcggaatagcacacggcttgttccgtgtcggtcaattaactcactaattaactcttggcggacttcccgacgctgttcttcgctagcatccgaattaataatacggaacatcggctcaacatcttcttccgccagcaattcgctgatactttcctgctctttggcacttaacggcttatcgttaagcaaggtagcgacagcatcggcgacaggctgatactgtttctgttcttccacaaaggcgtgataatcgtagaaacggtcgggatctaacagggctaaacgagcgaaatggctctcttgccctaattgctcaggggtcgccgtgagcaacaagactgctgaaatctgcttggagagttgtgcaacaaactgatatgccatacttggattttgctcgtcccattccaaatggtgagcttcatcaacaatcaacatatcccaatcggcatcaagcacttgttttgcacgctgtggatttgccgataaccaatcgatagagacaatcactaaggcttccgtttcaaacggattttcactgatgtcgttattatcttcatctttcttagtgaaatcggcacaacgttcctcatcaaacagcgaaaaattcaggctaaaacgacgaagcatttcaaccagccattgatgttgcaaactttccggcacaagcaccaacacacgatccactcgtccagagaaaagctgttgttgcaaaatcataccagcttcaatggttttccccaaacccacttcatcagccagcaacacacgaggggaaaggcgttgcccaacttctttagcaatatgtaattgatggggaattaggcttgcacgaataccacgcattccacgcagttcagattgaaactgggcttgttgatgtttcaaagcacgataacgcagggcgaaacgatcactgcgatcaatttgggcggaaaataaacgatcctgcggtttactaaaactcactttatgatcgagttgcatctcaggcagaacgctctcttcttgagtatcgacacgtttacctaaatagagcgcaacctcttgattttcaacgacatcttcaatatctaactgccagccatcaacactggtaacacgatcgcctttttggaattgcacacgggttaaaggggcaacggcaacagcgtacacacgttgttcgtccgatgcaggaaatgaaagggtcacagtgcggttatccactgcggtgacaatgcctaatcctaagttattttccgactcactaatccaacgttgtccgactacaaagctcatacttacctctctgctattctactaaaattttcggggactatctgatcttggtggagcaagcggtcagattttgccattattgtttccataatttgaactgattaatcaaaccattcgttgaactatcgtggctagtaatggtttcgttattttctagctctggcaagatacggttagcaagttgtttacctaactcaacgccccattggtcaaaactataaatattaaaaatcacgccttgaacgaagattttatgttcatacattgcaatcaacgcccctaaggtgaatggggtgattttttggactagaattgagttcgttggtttgttgcctgtaaatactttaaatggcacaatttctgcaacttcttctaaagatttacccgcttgtgagaactcttgttccactacttcttttgacttaccaaaagcaagtgcttcagtttgtgcgaagaagtttgaaagcaatttagggtgatgatcgccaatcggattatgggtttgtgcaggtgcaataaaatcacaagggatcaattttgtaccttggtgaattaattgatagaaggcgtgctgtccatttgtacctggttcaccccaaatgataggccctgtttggtaattgacaacttttccatctcgcccaacatatttaccgttagattccatattgccttgttggaagtaagccgcaaaacggtgcagatattgatcataaggtaaaatcgcctctgattctgcacctaagaagttattgttccaaataccgataagggcgagtgttaatgggatattttgctctgttggagcattaaggaaatgtttatccattgcgtgagcaccatcaagtagttgctcaaagtgttcaaaaccgatagaaagagcaatagataacccaatcgcagaccagagtgagtagcgtccaccaacccaatcccaaaattcaaacatattttctgtatcaataccaaatttagcgacctctttggcattcgttgaaagagctacgaaatgtttcgccacagcagattcgtcttttgcagtatccaataaccattgacgtgctgaaagagcattcgtcattgtttcttgagtagtaaaggtttttgatgccacaaggaaaagggttgtttctggattgattttcgctaaggtctcagcaatatgcgtgccatcgacattagaaacaaagtgcattgttaagtgatttttgtatggacgtaatgcttcagtgaccatatatggacctaagtctgaaccgccaatcccaatgtttaccacatcagtaatcgccttgcctgtgtagcctttccagtcgcctgaaatcacacgctcacagaagcctttcatcttcgctaaaaccgcatttacttctggcatcacatctttgccatctacttcaacaggggtatttgagcgattgcgtaaagcggtatgaagtactgctcgattttctgtacggttaattttttcaccattaaacattgcgtaagtggctgatttaacttggcattcatcggccaatttacgcaatagggaaagggtgtgttggttgatcgcatttttagaaaaatcaacgagaatttgatcttcaaaacgtaatgaatatttatcaaaacgttttggatcttcattgaatagctgtggaatcgtcaaattctcagctttgtgctgttcaagggcattccaagcgaaagtttgggttggattgatgttttgcattgaattatcctctaaaatttaattttgtgattcagttgattgtgttgagcttagttcatctaagcgtttttctaattcattcaatttttcacgggtgcgaagtaaaacttgagattgaacttcaaactcttcacgagtaactacatcaagtttagcgagttgggcttgtaagatttgtttaaatttttcttctaaatcattgcccacattttttaaaccttgtggtaatgcattgtgaagttgctgtgcgagagattctaaattttttggattaagcataatgttccccttgtaaattagggcattaattctaaagaatttcagtaaagataaaaagcaaagaatagagagaatttaaaaaattagagaattattttatctagagaaataagaagatggctggggtactaggattcgaacctaggaatgctgggatcaaaacccagtgccttaccgcttggcgataccccaaaagaaaaaaactaacttgcgttagttcattcgatttgaaataagatggctggagtactaggattcgaacctaggaatgctgggatcaaaacccagtgccttgccgcttggcgatactccagtcgttttatttgcaagcttaaaatggtgcgggacgagggacttgaacccacacacctctcggcgccagaacctaaatctggtgcgtctaccaatttcgccagtcccgcaaatggtggctacaacgagattcgaacttgtgaccccaacattatgagtgttgtgctctaaccagctgagctatgtagccatttgcgtcaccatatcggctttgcggggcgtattatgctgatttcactctacctcgtcaaatacttttttgaaaaaagtaaatttttctgcttgtttgactagagattcggcaaattgtcagaaaaaacaacaataatctctataaaagactgattttataataagttaacgattgccgttttaaaattccatttcttgttttatctgttttaatataggttcaacatctggtaatacatcttcccacaactgaaacgcataagccgcttgtccaactaacattcctaaaccatcttggtattgtgttgccccttgtgaacgggcgtattcaagaaatggggtctgcatatttggagcatattgcatatcataaatgttggcttgtgtaagtaatcgtgctggcaattcgacgcacttgccttgcaatccaagcgatgtcgcattgataattaaatcgaacgactgttcgggaagttcatcgaaacaagcggattgaatttgcccaaactttgcaaacttttcagctaaactggccgctttatctgccgttcgattgtaaatggtgatctgctgttgagcttgtaataagggataaagcgcgcctttggttgctccaccagcccctaaaatcagtatgcgttgatgtgggttaagccagcctaaacgggcaagatcggatactaatccaacaccatcggtattgtccgcatataaacgcccatcatctaaccgcttgagcgtattacaagcttcggcttgtaagcaactttcgctataaatatccgcaagggcaaaggctctctctttaaaaggggctgtgatatttgcacctttagcaccttccgcaaaaaattgtttgagttgctgttcaaactgttgttcatcgcctaatttcgctacgtaagaaatcgctttgcccgtttgttgcccgaaaagtgtatgtattcttggggatttgctttgtgcaatcggatttccccaaactgcgtactggttcattgtctatccttgtcgaaaaatatgttggctaaaaatgtcacggatttcagacggatttgactttccgcctgtggcttgatctaatactgggaacgatttgccaaattgctgtcgtacttcgtcggcagttaggcaaggtgggagtgtcgttaaatttgcactcgtagaagtgagtgcaaagcccgtcgctgtacaaagctcgacaacggctggcacttggcataatcgcacagcaatggtgtcaaactgccctttcagataacgtggaactgtggctttggctggcattatccaagtaattgcctgttcgcctagcgtttcaaaacgttgccattccacctctgtcaaatgtgtatcatcaatgtagggtagaagcagttttttattatgggcaattaaaatcagccctttttcttctggacgattttttaattgaagcagagatcttaccgcttgctcgctttgcggattgcaacctaatccaaaaacggcttcagtaggataggcaatcacttgattttgtttaagtttgtcaataagttgattaaaagaatacattattcgctttcactaaatagatgctgacattttctgtttgcacagagaaaataggattttccacgcacttttttgatggtggctaattcacctaaacattgtggacattgttgctttatgggcttggttggcaaggtaaatttacactcaggaaagcctgaacagccataaaatgttttacctgaacgccctgttcgtgccactaatttatgtttctggcattcagggcagtcaaattcttcctcgatttcagcttcttcgtgtaccgtaaaatggcagtctggatactggctacaaccgataaacataccaaaatgcccctgttttaattgcaatggcgattgacattcagggcattgttcatcaagggttttgatgatatggcttgcttggtggataggtttgaggtaatcgcattgcggatagctactacagcctaaaaaaagcccctgctttccccgttttagttgtaatggagaatggcattgcggacataattctgtctgtttcgtggacttaaaaaggctcatttttaaactaaattaactcaaattcaatcacaaaaaagtcgttatggttcgggtaaatctctttgattacttgttttagttcggcaagtgtcatattttcttgtttagcgtgcgtatcattgagctgttcaaactgaataggggtaacagatagtacacgaatatgagcaaacaagcggtctgtttcatttgtaaaaacacttaactcttggcccgcttgaaaatagctttctgacttatcacgaatggtaatggtctttttaccactgacaatgtctgcttcaaaacgactaaaaaaagtaatcttattcatcgtagtcaccataatctagatccaataaatgcctaaaatgatcgttataaaaaccgtggctcaccatatatcgccacattttttgtttcgcttttatatcccaatgtgatggtctttttttctcaaaaagccgttcggcaagttcaaaaaaatcgacttccgcttcatcaatggcttggctaattacccactcttttatacctttgagctgtaactcttgttttagacggcgtggcccatagccttgttgtgaacgatagcgaacgtaactgatggcaaaacgttcatcactttgccatttattcgcttgagcctgttcaatggcttgctcaatttcttgtgtattatattctttaagttgtaatttgtggcgaatttcagcttcgctatattctcgtttagaaagtagataaagcaaatagctattcgcagaatatttatgtgtcatttatttaccgcagtaaaataaaaatgcggttctcacaaaccgcattaagttattatagttcttcttcgctaaactcttcgacatcgctttcatcattgctgtcgcttgccgtcgcttttaatacgctatttgggtttgacgccaatgtatttcggatctcttgttcaagtttatctgcaatttcagggttctcttttaaccatttcactgcattatttttaccttgtccaattttcgttccgtcgtaagagaaccaagcacctgatttcttaataaagccatttgcttcagctaaaatcagtagctcattcatacgagaaatcccttcgccgtacataatatcaaattgtacttcacggaatggcggtgcaactttgttttttactacttttacttttgtttcactaccaataatttcatcgccatctttgactacaccacaacgacgaatatctaaacgaacagaggcatagaatttcagtgcattaccgcctgtggtggtttctggattaccaaacattacaccaattttcatacggatttggttgataaatacaactaaacagttggtatttttgatgttcgcagtaagtttacgcaacgcttgtgacattaaacgtgcttgtaagcccatatgcgagtcacccatatccccttcaatttcagcttttggcgtgagtgcagcgacagagtccacaataatgacatcaactgcccctgaacgcactaacgcatcacagatttcaagagcttgttcgccgttatctggctgagaaattagtaattcatcggtatttacccctaaattgcgagcatagacaggatctaatgcgtgttccgcatcaataaatgcacaggttttattgcctttttgagcttgggcaattaaagaaagtgttaaggttgttttacctgatgattctggcccatagatttcaacaatacgtcccattggcaagccaccaataccaagagcaaggtctagtcctaatgatcccgttgaaacagactcaatatctaattgttcagtctgccccaatttcataatagagcctttaccaaattgtttttcaatttgagcaagtgccgcttccaatgcttgttttttctgttctggttcaacttgtttaacgacggtattgttttttgaagatttcttattctcagccataatgctttcctttgttcattgtttggatagggcaatcgcattgccataaaactgtaaattattatactgtttaaccatacagtttcaactatttttttcagtttttcgatctatgtcacaaattttgccaaattaccgcaagatgtgaccgcttgtgattgaaactgctctttgcagatcgaaaggatttaaggcattgatcaccattatctgatcataatcaaaaagtgcttccacaggtatatcaactaagctaattttttgctcgtctaataaatggctcagttgtgtgccttttaataaataatgatttgggctataccattttccttgttttaaaaaaagtaaattgccaatagaacaatcactaataaaaccattattaacaagaataatttcatcacaagcggtctgttttaattgttctaattcaagtcggtcagtatatttgaattgataatcaaaattctctacataaacgcattgaaaggtttttatttttttaggtacataatggaaaaactgaacttgatattcttttgtattataatcaatacgacaacgtactaatcccttttgatattcttcagggatattaataatctccgaaagtgcaaaattattctcttgtttaaaataatatctaaaagcattattcattcgttgttgatgataaaaaatattctgcactttaccatcaataatcgcaattgtttcaaagagtggatattggcacataaaccttctctaaaatttcattatattcatcatctagctgacttaatgcagtaattccgccaccgctacgaaaataatatttgtccccttgtttttcaatataacgaatagccactgcactctctacattttcaccatcaaaataaccgaaaatacctgtataatagccacgttcttgttgttctgcctgctgaataatttcaacggttttcactttcggtgctccactaattgagcctgctggcaagagtttatccaacattgtaccaatattttcttgccaattttcatcgagctccccacaaatttcagaactcgtctgataaatcgctccacgatgtgttactactttttcaacataacggtatttcgtaacctgaatatattttgatactaaagctaaatcatttcgaattaaatcaacaatagtattatgttcggtaaactctttttctgaatttaataatttatttactgcatcttcttcatttgcatttattgtgcctttcataggataagaatagattttattctcttttatacgaataaaacactcaggggaaaaacagacaaaattctcatctaataacaatttgtatttagctttgctttgctgaaaaatttgtgctaaatgataatttgttttaattttagtttgctgagttaagtttaaaagataactattcccaatttggatctgttgttgaacaaaatcaaaggcttttttatattgtgtataattaggtggaataatctctaactcaaaattttcatttgtttttaatgattgaataaacttttgttgtccattaaaatcaaaataaagccctttatcttctatttcagataaaggataaattaatggtttctgtttttcaaaatcaattaaaaagaaaaaaggcaaacgcatttttccatactgattagctatttgaataaattgttgcattttgatatttctattattcgaagttaaaacctatgtcccattcacattcttatatggagacgcacgccccacaaaataagcctatcctattgattagtttagctattataacgacttttatggttgttgaagcaatctctggctatttctttaatagccttgccttacttgctgatgccgggcatatggcaagcgatagtttatcgctcttattatcactttttgcataaccttgcaaaacgttttcacaaaatggatattcacgccacattgcaaaatgatttagccgtttattttgaacagcacggaaaaacagagtgcacccaccatcattaactatttgatattaatcaaatagttaataaagaccgactaaaatagtcggttttttgttgcctttagtaaaaaaagcataacatctctaacgtagtgcaactttggagaaaaatatggacaacttaatttgctataaacagatgccagtttggaataaagaaaacctaccacagatgtttcaagagaaacataatactaaagtagggacttgggcaaaattaacgatcttgaaaggatcattgaaatactatgaattaaccgaagaaggtgaaattgttaaagaaatgattttcgatgagcaaaaccaaccaccttttgtggagccacaaatttggcataaagttgagccactaagcgaagatctagcttgccaactcgctttttattgtacacccgaagattatttcgctaaaaaatataatctcaccgcaacacattctgaagtattaaatgcgatgaattatctttcgactggaaaagtactagaccttggctgtggaagaggacgaaatgcactctatcttaacttaaaagggtttgatgtaaccgcagttgatcagaatgaagaaagtatccatttcctcaattcaatcatcgaaaaagaaaatgctcaacatatccaaacaggtatttacgacatcaaccaagctaatatacaaggtgaatttgactttattgtttccactgtcgtaatgatgttcctaaatcgtcatcgtatctctgcaattatcgaaaatatgcaaaaaaataccaaagtcgggggatataatcttattgtctgtgcaatgaacacgcaggatttcccttgtccaatgcctttttcatttacattccaagaaaatgaactgaagcagtattatcaaggctgggaacttgttaaatacaatgaagatttggggcatttacataaaaccgatgaacacggcaatcgtattcagctacgttttgtgacaatgttggcgaagaagttggggtagatcgcgtagttctcatcttaaactcaattttatggcataatggaaactttataagaatctattgttatcaatgacaatagattcttcgttttatacattatttggattttatcaatgcaagaaccttactatcgcgggcgtttttccgttgcaccaatgctcgattggacaactcgccactgtcgctattttcaccgtcaatttactcaacatagcctactttatagtgagatgattaccgcacccgcaattttgcacgcaaaatatgatctgcttgcttacgatcccacagaaaaccctgtggcattgcaattaggaggaagcgatcctgaacagctggcaaaatgtgcaaaattggtggaagaacgaggctatgcggaaatcaatatgaatgtcgggtgtccgtcagatcgtgttcaaaatggtatgtttggtgcttgtttaatgggaaaagcggatttagttgctcgatgtgtagaagcgatgaaaaacgaagtgagtattcctgttaccgttaaacatcgtatcggcattgacgatctagatagctatgaatttttatgtgattttattgagaaaattcagccttattgtaacgattttattgtccacgcgcgtaaagcgtggctgtcaggtttaagtccgaaagaaaatcgtgaaatcccaccgcttgattatgaacgagtttatcaactcaagcgggattttccacatcttaaaattagcattaacggtgggattaaaacgattgaagagatcaaacatcacttgcaatttgttgatggcgtgatggtcgggcgtgaagcttatcaaaatccgtctttgctcggttatattgatcgagagctgtttgacccaaatgttgagattgttacacccaaacaagcggttgagagaatgttatcttatattgaacaacaactttcacaaggcgtttatctcaatcatattgtccgccatattcttggcgcgttccaaaactgcaaaggcgcaagacaatggcgtaggcatttaagtgaaaatgcgtgcaaacaaggggcgggtgtagaagtggttgaacaagcattatcttttttgccttactagttgcaaaatctattaaatacttaacgactcaggtgcttatggtttattgcaggtgtaatagacaaatttattgctaaaaagtgacttaaagccttatagtacaaggctttaagcactctttttgaaatataaacaaaaactgcccattttgctaaagtctgaaaataaagaaacatggtacatcaaataatattcaacgatattttgtcataagggtcataaaacattttcctttaagaataaattagatccaattaaaatttggactgattacacatccggaaaacaaacctatcaacaacttgccgttaaatatcattgttcagtcagaacgattcaaagatatattgataaagcacctaaaacggctttaaaactacctttaaatcgatacctaaacatcattatggatacaacgtttttaggacgttattttagcggattcgtgttaatggatacgctttcaaataatgtcatttcctattattttgtgcgaaccgaaatgatatttactacaaacttgccctgaataggttaagagaaaaaggctatataattcaatagattacttgcgatggtaggcgtggtttgatgaaagatttatttaatacctcagtacaaatatatcaatttcatatggtggcaattgtgatgagaaaattaagaaaaaaacatcaattacaagtgggcaaagaattaaaaataattgtaaaaacactcacaagaagctcaaaaaatgaattttatcggcgattacactcttggttcataaaacaccaagcattttttaaaagaaaggagtgataaagcgaatgaaaaaggctattttccttataaacatcgcaatgtaagaagcgcttatgtcagtttaaaacgttatatggattttatttttatctatgaaaaacattctgaattaaatatagaaaagacggaaaatcgcttagagggggtatttagtgaacttaagcgaaaattaaataatcacaatagattaacgaaaagcgaaagatgttgtttataaaagattttttaaataaaaagagttgctaatatttaaagaaaataaacattagcaaccattttgtctactatgcctttatctactataccggattaaccattaatcatctaagaaactgcgtagagtttcggaacggctaggatggcgaagtttgcgtaacgcttttgcttcaatttgacgaatacgctcacgagttacatcaaattgtttacccacttcttcaagagtgtgatcggtattcatatcaataccaaaacgcatacgcaatacttttgcttcacgaggtgttaaaccctctagtacagcattagttgcaattcgcaaactttctgccgttgcagagtcaagaggcaactcaagagagctatcttcgatgaaatcccctaaatgtgaatcatcgtcgtcacccactggcgtttccattgagattggctctttagcaattttgaggactttacgaattttatcctctggcattcccattttttctgctaactcttcaggtgttgcttcacgtcccatctcttgtaagcattggcgagaaatacgatttaatttgttgatcgtttcaatcatatgcacaggaatacgaatagtacgagcctgatccgcaatagagcgtgtgatcgcttggcgaatccaccaagtcgcataagttgagaatttataaccacggcgatattcaaatttatctactgctttcattaagccgatgttaccttcctgaattaaatcaaggaattgtaaaccacggttggtatattttttagcaatagagatcacaagacgtaagttggcttctaccatctctttcttcgctttgcgagcttttaattcgccatctgcaatacgtccaccaatttcacgaatttgcgtaatggttaaaccagttgtttcctcaagtctctgtaagtttgcgatatttacacgaatattatccacatagttggctagcttaggcactccgccttttttcgcattgatcgctttttcaatccacgcttcagataattcattaccttggaatgctttaacgaagtccgcttttttcattccagcatactccaccgcataacgttgaatttggcgctcttccgcacgcacttgcttcatcattttttgcattgattcaactaacaaatcaaattgttttggcactaaacggaactctcgaaaaatatcggaaagtgcttgaatttgatctcttgaacgcttgctagtacgtccgtgtttttggattgcttgtaaagctttttgatgttgctcttttaatagcgtaaatttctcacgagcaagctctgggtcaatgctattgtcatcaccgccatcgcccgatgattcgccatcttcatcttcactttcatcatcaatatctgcaacggtatcactttcgctttcttcatctagatcatctacagaggtgctttctactgcatttggatcaacgaaagcggttacaagatcggataaacgtacagtgccttcttcgacttgatcataacgagcaattaattcacttaaggcttcaggatattctgcaattgcacattgaacttcgttaataccttcttcaatacgttttgcaatatcaatttcgccttcacgggttagtaactcaacagttcccatttcacgcatatacatacggactgggtctgtggtacgaccaagttcagactctaccgttgaaagtactttagtcgcctcttccactacatcttcatcggcaatattgcccgcaagcattaaatcatcagcatcaggggcagtttcaagtaccttaatccccatatcgttgatcatttgaatgatatcttcgatctgatctgcatcgacaagttcttcaggcaaatggtcgtgaacttccgaaattgttaagtatccttgctcacgcccttgagcgataagaagttctaactgagattgttgttcttctaattgagagtattgttccatagctttatccgttcttaagagcaaaaataagtagtggattataccactgctttgggtgtgataaatagtttcgcgaaaaattatcagtatttgaccgcttaccgtccagccaatagcatcattaattcctgcttttcctgttgatttaaccctgtcgtacgatcttttgccattaaaatgtcaatttgtcgatcaagcagtttcttatagaaaaaatcaagcgtatcaataaaagtgttttcgacattttcagaagataccaagtgatcccaatttgccaataattctaaatggcgataatttgggctttctcgcagatattccaataaaccgcccattgaaataccaagattagcgtgacagatattgactaattccaaaaataaatcgaagcctttttcctgcaaactctgcaaaaatgtcacatcttcaggtacattttgaaccaaatgaggattttgaagcagtaacgcaatcagtaaccgcatcggtgtcctttcaatatgtggcatattgtggcgtttaggtgcagtttcaacacttttctgagacagcatcgattccaattgtattggatcaagaatacccagtttttgccccaatatatttcgtaaatacaaacgtaacatttcccctggaatacgcttgatcaaaggtaatgctaatgaagcgagcttagattttccttctttagtggaaagatcgacctgagtaagcaaagaatcaaataaaaattcactcaatgttaatgcttgttccaaatagcgttcaaacccctcttttccctgaacgcgaataaaggtatcaggatcttccccatcgggtaagaagataaattttatctgtctgccatcgtgtaaataaggcagcgcattttctaatgctcgccacgcggcatctcgccctgcacggtcgccatcgtagcaacaaatcacttgttctgttgatctgaacatcaactgaatttgttcacctgttgtcgctgttcctaaagaggcaacggcattattcactccaaattgagctaaagctacgacatccatatagccctcaactacaaataaaaactcaggtttttcattatgttgtaaggcttgatacaaaccataaagctcattgcctttatgataagtggcagattcaggggaattaaggtatttcggcttttcatcgcctaatactctcccaccaaaagcaattactcgcccacgcttatctcgaatcgggaacatcacacgattacggaaacgatcatacacattgccacgatcatttttagagagcatacctgtatcaagcaacttttgcacttcttcaggattgtttccaaaacgacgaagcactgcgtccatcgcatttggtgaaaaaccgatttcaaagcgttcaataatctcttgagataaacctcgttgctgcaaataggcttgactagccctgtcttgcgttaattgctgttgatagaacttagcaaccaaatctaacaattcataaagattacgccgagttttataactggcttgtggtttgccatctctattgatcacattttcacgaggcacttctaacccgtgcaatgcagcaagttcctcaattgcttcaggaaactctaacttgtcatattccattaaaaagctaatgacattaccgtgtacgccacaaccaaaacagtgataaaactgtttagattggctcactgtaaaagaaggacttttttcgtgatgaaaaggacaacaggcttggtaatctcgccctgcttttttgagtttaacacgactattgatcagctcgacaatatcggttcgagcaacaagatcatcaataaatgaacgaggaatagagcctttcattgattatctccttgctagcaagcggatagttttgcaaatttttttacaattcagaccgcttatgatggacggtataaacattgaaaccgtgattccttaaaggtttcacggttccaatttaacttctgctacctaatttaaaattagtataaacgagtgttacgcgcgttctctcggaagttacgtttagcgtgacgttttgctaaagacgctttttcacgtttacgaattgtagttggtttttcatagaactcacgagcacgaacttcagctaaaagacctgctttttcgcaagagcgtttaaaacgacgtaatgctacgtcaaatgattcattttcacgaactttaattactggcataagccatcacctcaggaaatatatgtttaaatgaagccgcacaaattggtggcggcatagaactaaaaaaggtgatgcattttagcttagactaactaataagtaaagagcaccttatcaaaataatctacaaacatacagcttttccaaaataactttactttggtattcactgaacaataatcttggaaccattagaaaatacgatgtctcttgcctcataaattgcatttaatgcaatattatttctaaaactatcctgtatattctgaggcaaagtatccaatgaaatagagaatattacttcactagttgtacctctttttaaattctctttaaaagaaactggggtatcttgtacaaggacaatttcatcttgataagaataattcgttttccaatgaacactacgaatattacgcttacttttattttttatggtatatttgaaattcactataaagttcgacgatttattctgagatatctcagctcctataaaattaacttcaatagtatcagtaaagtgctttaaattttcttcctctcttgtgagtttagcattcttatacacatttttttcagagacaaggggactatttttatagtttctgcattaacacctaacgtaacccaactagataaagaaagtacaatcagatattttatcaatttcatatttctctccttaatagtacatgcatagaagaccatgtaagattatcttcatctcatgtagagaagacttccttatctcggacatattacaaaaattacagtagaatgacaattataacttattcagtccaagtaattttataaaatagaaaaccattttcctatatatttacaatcttgctccatcaccaactggtaacttggttttagaaaacatgtataaaaacgaagtatgtatctataaattcttaaaaatacttcaatacttttattcttgcaaagaaaaaataccgattttctaataatctcaaaaaccggtatttacataaattactcctcaatatctaaatatcaatcttattgaatttggtttatagagaagtatatttcatttcaattatacgaaatggacaaatattatttagtatctatgactggtgttgcttcttcagtctgagaagacactgcgtcctttatcccatccactttagtttcaactaattgttttacctcttcaattggatgagatactgcatcttttaacccgtccactttagtttcaactaattgtttagtttcttctactttagtttctgttgtttgttttacctcagcaactttctcttttgcttgatcacaagcggttaaagaaagcgttgctgcacctaaaactaaagcggttaataaagattttttcataaaaataattcctataaattaaggtttaaattgccacatttagagtaaatacttaggaattagttccctaagcatttacaagtgattaaagatcaaccttttatttttgcaaccctcggtgcagaataaacgtggctcactgcactactatgtccgccaaagccttttccgtagaaatagtattttgagttctgccactcttttgcttgaattaaggcaatttcttccgctggtgctgctgcaaccgtcatttctacttgcgtatgtgcaacacgagagaatgtgcctagtttcccttcaaactgatattgactttgataaaccttaatcggttctggaatcggagctgcaactttctgctcagattcgaccgcttgaggccctagctcttccaatttaatatggcgacgttcgtgattttctttaactaaatctcggttagtcggttgagaaaccacaagtccgaatggtttagccgataaagccactgctttcggatcaacttctgcggattctgcttcaactttcgtacgacgtttgtggttgtctttgactaaatcacgatctgaactttgagttacgaaataaccaaatggcaccgctgaatcttgatgagcctgagtgttagcttcctcttttacgggttcagctacttctcttgctacagattgaactggctgttcttgctgttgtaacatctcatcaacagataagaaacgaggtttctcttccgcaacagcttttggcatttcgctaaatttaatccaaaccttaccgcttgcaagttcaggcgaagcgacagccgaagttaatggcattactgcttttacttcctcacgacgctcacgacgacgctgattgcctacgcgtaaatggcgaggtaaacggcgttggcgaggctcacattgctctgtacgctcttctactacaggctctgaagtttccaaaggcatctctgcatttactgtagtcaccacaggctctgccacaaatgaatcagccgcattctcttctgctggtggtaaagaagcggtaatttccgctgaatgttctgcagtttcaattcgcactttcttacgtaagtcacgacgttggcgacgctcagccactttcgcttcacgctgttgcggaactgaaacacctgccacttcttctacaatttcacgacgtttcttaggctctactggaacgacttcagcttctttcgttgcttcaacgaccgtgtttttacgctcttggcgttcgttgcggtttggtttttcacggcgttgctgacgacgttcacgctggttacgagccttacctttaccttgcttcttctcaggttctttctcttcgcttgcaaacattgctttgattttcgcaataattcgactgattaacgaaggttttgctggctcaactggtgttggtgcaggctgtaaatttaactctgaactttgtaatactgattcaacggtaatcactggcttattacggctaaccaacgcttcttccgaatggtgatgatgaatgtgattttcttcatcttgttcttggtagcgtttcgctaaatcgtaacttaaggttggaacgatctcattctcacgcaggcgatatacgctaaagtgtggggtttccatactttcggttggtacaacaatcacttggacatcgtggcgtttttcaatgtcgctaatcgccttacgtttttcatttaataagtacgaagcaatttccacaggcacaatagcgtgaacctgtactgagttttctttaatcgcttcttcttctaataaacgtaaaatggagagtgcaatcgactcgttatcacgaatttttcctgtaccttgacagcgagggcaaacgtgtgatgacgcttcacttaatgatggacttaaacgctgacggctcatttcaagtaatccgaaacgagaaatgcgtccaaactggattcttgcacgatcttggcgtgtcgcttcacggatacgattttccacttcacgttgatgacgaactggggtcatatcaataaagtcgatcacgattaaaccgcccaagtcacgcaaacgtaactgacgagcaatttcgtctgccgcttctaagttggtatttaatgctgtttcttcaatgtctccaccacgggtcgcacgagatgagttgatgtcgatagctgtcaatgcttcggttacatcaatcacaatagaaccgcctgacggcaaacgcacttcacgttggaatgctgattcgatttgggattcgatttgatagtgactgaacaacggtacttcaccttcatacaggcgaacacggttgataaaatcaggacgcacaaggcggatatgattttttgctttctcaaataccttacgattatcgatcaaaatctcaccaatatcacgacgaagataatcacggattgcacgcacaatcacatcactttcttgatgaattaagaacggtgcagggcgagattctgccgcttttttgattgcctcccagtgatgtaataaaacttttaagtcccattgtagctcttcaggggatttacccaccccagcagtacgcacaattaaacccacatcttcaggtacatctaagcaatctaacgcttctttcagctctaaacgctcgtccccttcaatacgacgagaaataccgccagcacgagggttatttggcattaaaacaagatagctaccagccaaagagataaaggtcgttaaagccgcccctttattaccacgctcttccttgctgacttgaacaataacttccgccccttcttgaataatatcttttatgtttgggcgaccttggaatacataaccttgagggaagtattcacgagaaatctcttttaacggaaggaaaccgtgacgctctgcaccgtaatcaacgaatgctgcttcaagactgggttcaacacgggtaattttacctttgtagatattcgctttcttttgttcgtgtcctgggctttcaatatccaagtcgaacagtcgttgcccatcaacaagggcaacacgcaactcttctttttgagttgcattgattaacattcttttcattgtgttttctcattttatttttgttagtgctattcatagggttcgggtttgtatttttgctaatctgtcaatctcccgactgtctaaggacaaactgacgtgaaccctatgatctaaggtgatctgttttatgtcttacactcaaaatctgaccgcataatcaatcacgatatttgcatttttaaccgttgcaagcggtacttttgtctgattttctacaattttattcagtaaaattcaatagacagaaaaagcgagtcattatggcattttaagagaaaaatagaaaggcaaaagtaaataacgtaccataaataacattgaatgtattttatacaatgtttgcggctactaacgaaaaaggtagtctctctaataacttctgatgaatcccgccaaatgccccattactcatcactaaaatatgatccgttggtttagcttccttgacaatcaattccactaattcatctaggcttgtcgaccattgtgccggctggcttagtgcatctgtaatcgtgctgacttgccacggaatggtatcgggttgataaacaaagacggcatcagcgtctttcaacgatggggcaatttcctctttgtgaacgcccattttcattgtgtttgaacgaggctctaataccgctaaaatgcgttgttctttacctactttgccacgaagtgcgtcgatggttgctaaaatagcggttgggtggtgggcaaaatcatcataaacggtaatgccattcacttcccctttgacttctaaacgacggttggcattgataaagctgtttaaacctaaacaggcttgctcaacgcttacccccgcgtgatgtgctgcggcaatcgccattaagccgttgtgcatattgtgagcaccaagcaagttccatttcacttctcctgctttttgctgtttatggtaaatcgcaaaatgagaatagtctgaacttaacggctctgcaaaccattcttgattttgtccgataaattgctgctcgctataacagcccatttttaaggtgttttggacattttcatctgatgttgcagacaaaatgcagccattttgtggcattgtgcggataagatgatggaactggcgttgaattgcttttaaatcatcaaaaatatctgcgtggtcaaaatcaatgttattaataattaaagtttttggattgtaatgtacgaatttagaacgtttatcaaaaaaggctgaatcatattcgtccgcttcaatcacaaagaaatcgcttgatcctgcacgagcagaaataccaaagttgcctgccacaccgccgattaagaaacccgtatcaatgccagcttgatctaaaatccagcttaacattcccgttgtggtggttttgccgtgtgtgcctgaaacggcaagcacccaacgatctttgagtaaatgatctcttagccattgtggccctgaagtgtatggcaagcggtgatttaagatatgttctacgcaaggattaccacggctaatcgcattgccgataataatcatagcgggaacaggatcgagctgtgcaatatcgtaatgagggataatttcaatgccacttttttccaaaaaggtactcattggtggataaacattggtatctgaccctgtgactctataacctaactcccttgcaataatcgccacgccacccataaaggttccacagatccctaaaatatgaatatgttgctgtttcatagcattccttacataaaaattgtgaacagtatcacaaaacaaaactttactcgaaaacagagcttcaatgggcgagtataataaagcaaactgcattgaatagctaataaggagataaaaaatgaaaacattaggcgaatttattgttgaacgccaagcagaatatccaggagctacgggggaactcagtggtattctatcgtccattcgtttgtcagccaaaatcattcaccgtgacattaaccgagcaggtttaacccaagatattttaggtgtatctggcgatgaaaacattcagggcgaaacccagatgaagctcgatgtatttgccaacgaaacaatgaaaaaagcattaattgctcgtggcgatgtggcaggatttgcatctgaagaagatgatactttcgtggcgtttgatacagaacgtggtcgaaatgcaaaatacattctaatgacagatccccttgatggttcgtccaacattgatgtgaatgtgtctgtcggaacaatcttttcgatctacaaacgtgtatcaccgattggtacaccagtgacgatggatgatttcttacagcctggacgtaaacaggttgcagcaggctatgtgacctatggttcatcaacaatgttagtttatacgacgggtaatggcgtaaacggctttacctatgatccttctttaggtttgttcattctctctcacccaaatatgaaaatgccgtttgaaggcaaatattattcgattaacgaagggcaatatctcaaattcccagagggcgtgaagaaattcattaaattctgccaagaagaagataaagcaacggggcgcccatactcttctcgttatatcggctcattggtttcagacttccaccgtaacttgttaaaaggcggtatctacatttatccaagtacgaaaagccacccgaacggtaaattacgcctactttacgaaggcaacccgatggcatttttagctgaacaagctggtggtatggcgacagacggatttaatccgattttagatattaaaccgacagaactacatcaacgtgtgccgttctttgtgggttcaacagcaatggtgcaaaaagcgggtgagttaatggctgaatttcgctagtaaataatggaaagaaactcaccgcttgtttacgcaagcggtgagttttttatatcattttgttataaagaccacatttttgttctttaccttcaataaaataatgagtatcttactcgcaatttttcactctttattggagatattatgaaattaaatacaaaattctctctcttagccgcaacattattggtttcaaccgttgctcaagccgcagataaaacgtttattaactgtgttagccgttcaccaacaggctttagccctgcattagtgatggacgggatttcttataatgcaagttcacaacaagtgtataaccgccttgttgagttcaaacgtggttcaacagatattgaacctgctcttgcagaaagctggacagtgagtgatgatggtttaacttatacctttaatttgcgtaaaggtgtgaaattccactcaaataaagagtttaccccaagtcgtgattttaatgcggacgacgtagtattctcatttcaacgtcagttagatccaaatcacccatatcacaatgtatctaaagcaacttatccgtacttcaaagcaatgaaattcccaacattgttgaaatcagtggaaaaagttgatgaacatacagtgaaaattactttaaatcgccaagatgcgacattcctagcaagtttaggtatggacttcatctcgatttattcagcggaatatgcagataaaatgttagcggcaggcaaaccagaaaccattgatacaacccctattggtactggtccgtttgtgtttgcaggctatcaagtggatcaaaaaagccgttatttagcacataaagagtattggaaaggaaaagccgatattgaccgcttgatctttgaaattgtccctgatgctacggctcgttatgcaaaattacaagcgggtgcttgtgacttaattgatttcccaaatgcagcagatcttgagaagatgaaaaccgatccgaaagtgaatttactttctcaagaaggcttgaacattgcttatattgcgttcaatactgaaaaagcaccgttcgataatgtgaaagtacgccaagcgttaaactatgcggtagataaaaatgcgatcattgatgctgtttaccgtggtgcaggtgtggctgcgaaaaacccacttccaccaacaatttggggctataacaacgaaatcactggttatgaatataatccagaaaaagcgaagcagttattaaaagaggctggctttgaaaatggttttgaaacggacatttgggtacagcctgtggtgcgtgcttctaacccgaacccacgtcgtatggcggaattagtgcaaagcgactgggaaaaagtgggcgtgaaatcaaaactggttagctatgagtggggcgactacatcaagcgtactaaagcaggtgaattaacagctggtacttacggttggtcgggagataatggtgatcctgataacttcttatcgccattattcggtagtgaaaacgtgggtaacagtaactacgctcgcttcaaaaatcctgaattagatgcgttattacacaaagcggttggtttatctgacaaggcagagcgtgccaaaatttatgaacaagcacaggtattgttaaaagaacaagccccttggatcaacgtagcacactcaattaactttgccccaacaagtaaacgtgttcaagactataaacaaagcccatttggttatacttacttatatggtacgaagttggcggattaatctgtcttaacaggaaagggaagcaataagcttcctttttcattttattaccgatgagaagataaatcagctataattcttccccaaaataaagaaataaaatacacatcttaaataagggagaatatatggaaattaaatcgtcacggaaacgcttgaccctcaacgatatagcacaacttgcaggcgtatcaaaaaccacagcaagtatgatcttaaatgggcaggcagaacaatttcgcattaagcctgaaacccgccaaaaagttgaagaaatcgcaaaacagcacggttatcgtgcaaatgcttatgcaaaagcacttaaactacgtcgcaccaatgttattggtctggtcattcctgatttaaccaattatggctttgcctctacagcaaagactttagagaaattgtgccgagagaatggcttacacttggtcattgcttgctccgatgataatcctcagcaagagaaacaagcgatagatcgtttgcttgatcgtcaaattgatctcctaattaccgctccaacacatcaagatccaaaatactataaatccgtattaaagcatactcttctattacaacttgaccgctatgttcctcaacttgaattaggttatgtgattagtgctgataccgaaaaaattgcagaactagtatctctaacgatccaacgttatcaacttaaagaatatttttattttggcggtcaatgctcactttctcctagtgaatctcgtttagctggttttcgccaaggcttaaagcaaggtaacttacaagaagaaagcggttggattttacataaaaattaccaacccgaatcaggttatctgttgatggcagagctggttgaacgtttagggcgtttgcctgaagcagtatttaccgcgtcttatactattttggaaggtgttctacgttacctcactgaacacaagcaaatggataaactgttgaacggtcaattacatttagccacatttgatgatcacgatttacttaacgctctgccgtttcatattcattcgattaaacagaatcatcaacaaattgcattttcgctgtttaatctgatacgtcaaaagttgcaaggaaagccaatggagcagttaaaagtagaatgtgaaattatttggagaagataagatgattacaagtatagcctagatttttctccctacaataatagttaatccattcttgtcttactatattgtaaacaaaaatttccaaaattcttttttcggagtatcataagcggacagatcaaaggcttattttacaaaaggaagagaagatgcgatttgcgattgagtgtattgaacgtgtgggcgttgctcaagatattttaagtttattggcaacgcaaggcataaatttagaagggatcgaactgcaaaaattaggcgaaaaagggcttgtttatttgcgtactgaagcaatggagattagccagcaagctaattttgtcaaacagttgaagaaaattccaagtattactgctgttcaagaaattcatcatcttccacaagaacgtaaaaatcttgagttgagagccttaattgaggcgttgcctaatcctgttttatcgcttgatctcaacggtaaaattgcctttgctaattctcaagcctgtaaagttttattaccgatttatcgccagtcgctacctaagaaaaaacaagagcaaattctttctcttgaaggcgttgatctcaacgaaattatcgtcaatctcaatcgcaccaaatggtatcagtgggttttgcaacaagggcgttctattttaccgacaacgttacagccaatttctcaccctattcaatttaatgatcaagtatggcgaatggatttactgccgattgaattgtgggaggcggcacaaaaccgaccgcttgggtatgttgttactctgcaatctcagcaaacaatgcaactcgatttacgtcaatttatggcaaatcaaaacagtgatttcgatcatattttgacgaagagtgccaaaatgaaagcggtgattgaacaagccaagaaatttgcgacactcaatgtgcctttgcttattcaaggcgaaacgggaacaggtaaagatttgtttgccaaagcgtgccaccaatttagttttcgtcgggatcaaaaattcattgccgttaattgtgctggattgcctgaagaagaggctgagagcgaaatgtttggacatcacggtggcgaccgtacgcacgttggcttttttgagtatgccaatggcggaacagtattgctcgactcggttgcagaactatcccttgaaatgcaaggcaaattattacgttttttgaatgatggatcatttcgccgcgtaggtgaagataaagaaattcaagttgatgtgcgtgttatttgtacatcacaaaaaccgcttgcgaccttagttacggaaggaaaagtacgcgaagatttataccatcgcttgaatgtgcttaccttgaatttaccgccgttgcgtgaaagacaaggggatttaatgctactgaccgatcactttattacccaaatcagtcagcaactaggcattcgtaaaccgctttacgatgaacattttatcaaagctatgcaagcctatcattggtctggaaatttacgcgaactttataatgcaatttatcgagcttgctctttagctaccgatcaacttaaatcgagtgatcttaacttgcctgaaacggtaccaagccattttgaaatttcacatttagagcaaggttcattagaagagctggttaatcgttttgaagcctcactgttacgcaagttctatacggaatatccaagtacgcgtaaattggctcaacgcttaggtgtttcacatactgcaattgccaataaattgcggagttatgggatcagcaaatgatgaaacaacttatgctatggggatttgcatttttaggcacatatctcaccgcttacgcatcgcctaaaattccacaagcgttactgacagacagtctggtttactgtaccagtgcctctggtttttcttttaatcctcaaaaagccgatgttggttcaaatatgaatgtcgttacagaacagatttacgacaaactgattgaatttgatcccgaacaaaaccagctgaagcctgcccttgcagaacgctttgaaatgagtgaggacggtttaaccattacgttatatttacgcaaaaaagtctcttttcatcatacaaaatggtttacgccaacacgctatttgacaagtgaagatgtgatcttttctttaaatcgaattttaggcaaagttggggaactgcctgagcttaatcgagaagtacaacatcaagttcgtcaccgaattgcagaccgcacccatttctcttattttgaaagtgtcgatcttgctaatcagatcgtcgagatttcagcgccttcatcgcatatcgttaaaattcgtttggcacagcctgatagctcaattttggctcatcttgccagtcagtatgcggtgattttatcgaaagagtatgccttacaactcaatgccgatgataatttaatgcaactcgatattctgcctgttggcacgggggtatatcagcttgataattatgtacaaaacgattttgttcgcttacagcctaatcctcgctattggggcaaaaaagccaatatcagtaatttagtggtggatttctctacctctggcacagggagaatggcaaagtttttgaacaacgagtgcgatatttctgcctttccagaaccaagtcagctctctattttggataaaacgcaaggctatgtaattgaaacggctggggcaaaccttgcctttttagcctttaatttccgccaagataaaatgaaagatccagcattacgccaaaaaattgcgacaagtattgatcgtgagcgtctggcgcgtattctgttttacggcgttgctgaagtaccacaaaatgtactgccgaaggcgttgtatgcgcaagaaaatccaacaagctacccttattatccgcctgatacgagtaaaaaaatggaggaaacagaccgcttaacgctatgggtaattgatgagaaacgtgtttatcacttgcacccgttaaaaatggcggaatatctgcgtgcagagttggcgaaagtggggattacactcaatgttcgccaagtgagccgagcctatttaactcagcaacttgaaaatcatcaggcagattatgatttaattctaagtggttggttagccaataattttgatcctgatagttttctctcttcgattttaagttgtcgcttgcaagatgcggtgaccaatctatctaattggtgtagcgtggaatttgatgaattgcttaaattagcaagaaccgctgaagatccacaaagccgaatgcaatattatcaacaacttcaaactctacttgaagaacgcttaccgctgttacctttggtgaatgtcaaacggttgttagttgccaataacagcgttaagaatgtcaaaatcagtgcgtttgggcaggttaaattatctgacattaaggtgaaataaaatgttgttcgttcttattcgtaagctcttgttaatcatcatttcactgatgattttatcgcttatcagttattttattttgctgagaaatccgcattattccgtcattgaacaaggcttctcaggctatgcaatttatttgcaacaattgcttgaagggaatttaggcgttagcgaaatgacaggtgagcctttaacgaaattaattttaaatgtctttccagccacgatctcgctctgtttatcggctatgttactttcgttgatgctaggcattccgcttggcttttttgcggcgctacaacggcaaaatatgattggcaaactgttaggctcactggggtcattaagccttgctgtgcctgtattttggcttgccattgtcttattggcgtatgcttctagccatcattgggcaatttcagctgtcggcgaactccaccccatttatgcggtaccaacaatcacaggcgttaaaattttagatatttttctttcagatgcaccatataaattaaaaatgatgcaaagcgccttgcatcatcttgcactgcctacccttgtattagccgtgccagcgacgttagaaattatccgaatgacaaaacaacgtacggaatatgtgctgaaacaaaattatgtcaaagtcgctcgtacacgaggctggtcgccacttaaaatctggtgggtgcatattttacgcaataccttgcctccacttattccgatgatcgcaagaaatatcactttaattttcgcctttgctatgcttgtcgaaaatgtggtgagctggggaggcgtaggacgttggatagttaatgcccttgcactaaaagattacaatgcgatttccgcaggcgtgcttgcgattggtatttttgttctcagtgtggatttactggcaagcctattaactaccctacttgacccatcgcagaaaaaagattggtatgtcaaggtataagaaacaatggggacttttaggggtgctatatctcgtgctgttaaacattttttactctgctaatacgctttgttttctgcatttaatttagaaaataaagtttgttgtgtctcattgtatctactcattcttccgtgcatttgctatacttttatccctttaatttatttattcatcggatactgtaatgcaattaaaatcctacccagcgccaacctacgcacaacgtgccaaaatcgcgtttcaatatatgatgccacagctatatttaacccaaaccgcaggctggctggcggaacgtaaatggggggcaatcactcatttcatcatcaatgtttttgcgaaaaaataccaagtcaatttagcagaagccgaaaagactaatgcttctgattatgtatcatttaatgaattttttattcgtccattaaaggaaaatgctcgcccgattaaccaagatccgcaagcactctgtttacctgcggacggttgtgtgagtgagttgggtaaaattgaagagaaccaattattacaagcgaaaggtcaccaatttagtttagaaacattacttgctaatgatcttaatctggcagataaattcaaaaacggcaattttattaccacttatttatcgccaagagattatcatcgtgtgcatatgccgtgcgatgcaacattgcgtaagatgatctatgtgcctggtgagctgttttcggtcaatccatttttagcagaacacgttccaaatctttttgcgcgtaacgaacgtgtgatttgtgaatttgaaacggcatttggccctatggtgcaaatccttgtaggagcaaccattaccgcaagtatgagtactgtttgggctggagtaatcaatccgccaagagcaaaagaggtgacggtttatgaatatctcaccacaggtgaaaccgcagtacatctgaaaagagggcaagaaatgggagcattccgtttaggctctacggtgattaacttgttcccgaaaggtgccgtggagttggaagctcacttaaaagcaggcgagacaaccaaaatgggtgaacgtttaggtaaaataaatctctaaaagtggggcgttcatatacgccctttgttatgtgtaaggaaaacagatgaaagccaagttacttattccactgattgtttttttagggttaattattacctttactattcagcttcaacgcaatgccaatggagaagatccaaaagcacttgagtctgctctcgtaggtaaaactatcccagaatttaagttagagtcgttacacgaagcaacacagatgttagattcatctgtggttaaaacaggaacgccacgcttattaaacgtatgggcaacctggtgtccaacttgttttgctgaacaccaatttttaactgttcttgctaagcaaggggttgaaattgtcgggatagattataaagatgagcgcgctaaggctttaaaatttttaaaagattatggcgatccttacaaaaccattgtttatgatccaaaaggatctttagggttagatttaggggtttatggtgcgcctgaaacctttattattgatggtaacggtaaaattcattaccgccacacaggagatgtgaatgaaaaagtgtggaatgaagtgctaaaaccaatgtatgagaaattgaagtaatggctatgaagaaattatttgcactcttattgcttgtctccgcattaagcatagcttcgacggatattcagcaatttgataatgcacagcaagaatctgattatcgtgcgttaatccaagagctacgttgtccccaatgtcaaaataacaatattgcagattcaaatgcaaccattgcgacagatatgcgtaacaaaacccttgagctattgaaacaaggtaaaagtaaagatgaagtcgttggctatatggtggaacgttatggtaatttcgttacctatgatccgcctatcacaccagcgaccattctactctggcttatgccgttattattaattggggtaggtttaggcattatgtttaaacgtaaaaagcgtgtacaagcggtcagttctgagcagaaaaatgcaaatgtggttgatacagctcgccttaatcagattttaaacgaaaaggataaatgatgaatttttggattttagtcacgattattacgctgattattggcgtagtggcgttctaccctttattgaaacagcgtcaaaatttaagcacacaaaagcgagatagcctcaataaagccttctactttgaccgtttaaaggaagtggaacaagaagcggaagcaggtattattgaagatagcgagcagacgaagctcgaacttcaacaaagcctgcttgacgatattcctgagcatcaaacacaagcggtaagttcggcaaaatcatttggacatcttggcaaattatggtttatcgccttgattttattgattggcggtattagtgctgggatctattggaacattggttcgtggtttagtggcacaatgcttgaaatgagccacaaaaagcttgattatttttatgaaagagtaaaaacagaagaaaccgatcccctttcagaacaagagctgaaccaatttgcaatggcactgcgtgttgaactacaaaaaaatccgaatgatgataaacattggtttatgttaggtcagttaggaatggcgttggataatggacagctagctcttgatagctttgctaaagcgagcaaactaaaaccagagaatatgcagtataagttacgccacgctgaaattttattgttctctgaagacccaaaagataaatcacaaggtgagttattgctcaaagaagtgattagggcagatcatacaaataccaatgccttgagcttattggctttccgtgcgtttgaacaggaagactataaaatggcggcaatgacgtggggaatgatgttgaagctaatgcctgaagatgaccctcgtcgtcctacgattgagcgtagtattcaatctgcgttgtcgatgataaaatcaggagaaataaaaaccccctaactcaccgcttgttattttatagactagatgtaatgcaaaaacctctcgcaatttttttaatgggaccaacagcatcggggaaaaccgatcttgccattgccctacgtcagcagattcctgttgaggtaatcagtgtggattccgccttaatttataagggtatggatataggcacggctaagccgagtaaggctgaactcgaacttgccccccatcgtttaattgatattcttgacccatcagaaagctattcggtaatgaattttcgtgaagatgcgttacgagaaatggcgaatattacggctcaaggtaaaattccgttgttagtgggcggaacaatgctttattacaaatcattgcttgatggtttatcgccattgccttcagcagatccagctattcgggcagaaattgaagcaaaagcagagcaaatcggttgggcaggtttgcatcaagagctggttaaaattgacccgatttcagctgagcggatcaaccctaatgatagccagcgtattaatcgggcgttagaggtcttttatatttcgggaaaaacaatgacggaactcaccgctcaacaaggcgaaggtattccttatgagataacgcagtttgcgatagcccctcaagagcgtgccgtgctacatcaacggattgagcaacgttttcataaaatgatcgatttaggctttgaacaagaagttcgacagctttatcaacggggcgatttaaatgttgatctgccttctattcgctgtgtcggttatcgacaaatgtgggaatatttggaaggacaaacttctcttgatgaagccatctttaggggcatttgtgcaactcgtcagctggctaaacgccaaattacttggctaagaggttggatgagtgggttggaatggcttgatagtttggatcctgaaaattcttataaaaaaatgatcgaaaaagtacagcaaaagcatttgaaactgtggtaatatcgcaatgcctttggcaaagcattaaacaacaataattagaaggaacataaaatggcaaaaggtcaatctttacaagatccatacttaaatgcacttcgccgtgaacggattccagtttccatttacctcgtgaatggcattaaattacaaggtcaaattgagtctttcgatcaattcgttattttattaaaaaacacagtgagtcaaatggtttacaagcacgcaatttcaaccgttgtgccagctcgtgcgatttctcacaacaataactctaaccacgctcatcaagccgcaccagtgcaatctgctgaagtggtagagaaagtggaataattttattactacgttagacctcttgaatgaaccaaacacagcaaattctgtgtttggttttccgttgcctgaaaaaacacaaaacacgcctgacaaagagcgtgctattgtggtacatctttatctctctcaaactaaagatgtggaaaatctgatggaatttcaaactcttgccgagtccgcaggggtagaggttgtcgctacattgacaaccacacgttccgcaccccatatcaaatactatgttggtcaaggtaaagcccaagaaattgcggatgcaatcaaagattttgatgcgaccgtcgttttaattaatcaccaactcagccctgctcaaacgcgtaatctacaatccctttgcgattgccgagtggtggatcgtacaggcttgattttggatatttttgcccaaagagcaagatctcacgaaggtaagttacaagtcgagctggcacagcttcgccatttatccactcgcttagtccgccgtttaggtaaccaagatcaacaaaaaggcggtgcggtaggcttacgaggcccaggggaaacccagttagaaacagatcgccgtttaattaaagtgcgtattcagcagttacaaaaccgcttggaaaaggtaagtaaacagcgtgatcagaaccgcaaaactcgtcaaaaagcagacattccaaccatttcccttgtgggttataccaatgcaggtaaatcaaccctatttaatgcgattactgatgcaggtgtttatgcggcagatcaactgttttctacccttgatccgacattaagacgaattcaaattcaagatgttggcacagcgattttggcagatactgttggctttattcgctttttgcctcacgatttagtttctgcgtttaaatccaccctacaagaaaccacagatgcgacattgttgctacacgttattgatggtgcagacgaccgtaaaaatgaaaatattgatgcagttaatcaagtgttagatgagattgaagcattagaaattccgaccttgctcgtgtataacaaggtggatcgcttggacagtattaagccgcatatcgaatataacgatgacggcaaacctgtggcggtttatctttcggcacaacaaaatcaaggcattgatctgctatttgaagcaatgcgagtcagacttaaaaacgagctggtctgtgaaagagtactgctacccacaacaagcggtcagatttacactaaattttaccaacagcaatgtatcaaatcagagcgtttcaccgaatttggcgatcgtttagtggaaattgaagtcgataaaattcaatggcaaaagtggcttaaacaataccctgaactaacggaatttgttgagtttgcacaatgggaagcagagagttaattttgacctaaaaacaaaatatcgagcgtatctcaccgcttggttaaggaaataagatgacgaaacaattcaaattaatcggttttgacctagatggaaccctagtcaatagcttgcccgatttagccttatcgcttaactctgccttcgccgaagttggcttgccacaagcctctgaagagcttgttctgacttggatcggcaatggagctgatgtgctttttgcgaaaggaatggaatggacaggaaaagcagatgaattttcacaggaagaattagcccaaattaaacgccgatttggatatttttatggcgaaaatgtctgcaacatcagcaaactctatccaaatgttaaagaaacattagaaacacttaaaacacagggctatattttagccgtagtcacaaacaaaccaactaaacacgttttgcctgtgttgcaagcctttaaaatcgatcatctcttttctgaggctcttggtggacaatcgctacctcaaattaaacctcacccagccccactttattacctttgcggcaaatttggtttatatccccatgagatattatttatcggcgattctaaaaatgacattttggcggcgaaagcagctggttgtaaaagcgtaggtttaacctatggctataactacaacattcccattagtgagtctgagcctgattatgtttgtgaagattttgctgagattttgaaagtcatacgccaataactaataaggtagcatttgaataataggcatagtaggcaaatttattacccatctatcaaaaattattggcatagcagacaagagtgttgttttttgcaaactatgcctctaatgaacaaacgttgaacagttctaatggaacagtgatatttttcggataagtgtttataggtttgttttcctattgtgtaatcatctattggatttaatttatttgtggaagaaaatgttttatggcaggacgaacaaaagtatctctgaatattatttttatttccatacttttggatattgttcttaaggcaaaaaggacaggtttttattcatatttcaaaaagtggcttaaagccttatagtaccaggctttaagccactttttaccaacgcttttgtctactatgcctaatcatatctaatgatatcagcggtaaaacatttaataatgtaataatcattatatctgtttttgattttcagcccaccaagctgcgcctatcaatcctgcatcttgagcataataagcaggaacaacttcaggacgataaatttcaggcatttcggaaaggaaatgggttactctggctaaataaccttctgctaatccaacacttccgccaagggtaattcgttgaatgtctaagttaattttgagatcagcaattaaatgagcaatcgcttttgcagatttatccactaaagcagccgcttgtggatcgcctgctctgaagcgtgcaaacacttctggcggttcgcaagggttatcccatttggctgcatcacgagcaatcgcacgcccagcggcaaccgcttcgacacagccgacacgtccacagccacacacttccccatttggatcagcaaggctatgtccgatatgtccagctacgccgtttgtgccagtaaaaagtttgcgatttaagataataccgccccctacgcctgtcgaaacggtaataaaggcaaaattttcaatgtcatcttgacgtaaaaattcagcacaacccgccgcttgggcatcatttaacagcgtaatcggcttgtccgtgtgtttggcaacgctttgctcaagaggaaagaatgccagattgcctaaatttttcgggttaagtgcggttagaatacccttttgaataattcccgttgaagccaccgaaacctgatcaaatttccctttgaactgcgttaaaatttgtgccaaagcactgtctagagcttctgcacttggattttgtggtgtgtgaatttgtgtacgttccgccacaatcgcatcttttccctttaaggtaacaagagcagcagcgatttttgttccacccacatcaatggctaaacaagcggtcatattaggctcctgttttgcgattatcaatggcggtcacaaaccagctcacaatatgctcaaggcgagttaaagcagatccaacggttacagcataagccccattttcaatcgcaacggcagcaagttcaggggtattgtaacgcccttcagccattacacgacaaccactggcgactaaatcacgcaccagttgtacatctggctcatcaggggtttcaccgcctgtatagcctgacattgtgctaccgattaaatctacgcctaactcttggcagtacataccttctttgtagtttgagcagtccgccattgacattgctcctaactcttggatacgtcttgcacaggcttcaatcgtggttggacgaacacgatctgtaccatcaaaggcaataatatctgcccctgcgtgatacaaatcgtcaatatcttgtaagaatggcgtgatacgaacagggctgtcaggtaaatcacgttttacgataccgacaatcggcacatcaacgactttacgcaccgcttttaaattatcaatgccttcaatacgaagccctgccgctccgccaatgactgatgcttttgccattgccgctacaatctctggcgagtccatcggaccgtcatcaacaggttggcaagaagcaattaaaccattttttaattgttctaaaatttgttgtttggttaatctcgacataaaaactccattagcattaaacaaaaagaaaatttactccaaagcatacccctacaaatgaagtaatgcaatcaatagcattaaaaagtgagagatagatcaaatttttctacaaataaaaaacaaaacggtgaatttattacaaattcaccgttcaagataagtcgttataaaacgagttttaatcgattatttaaaaaattcaacggctaaacgagcaccgactttcgcattatttttcaccagcttgatattcgcttctaagctcttgccttcggtcatttcaacgattttaccgagtaagaatggcgtaatatctttacctataatgcctttttcttcggcttcttttactgctgtatcaataataccgttgatataacttggtgctaattcatcttcttgtggaattgggtttgcaacgaccacgccaccttctaagcctagctgccatttcactttgatcatttcagcaatttcagttaattcttcacacgataacgccaatggtaaaccgctatcacgagtaaagaatgctggtagatttttggttttataaccaacgacaggcacacctttggtttctaaatattctaaggttgcatcaaggtcaaggatagatttcgcccctgcacaaataacggttacgcttgtttgtgctaattcatcaaggtccgcagaaatgtctaatgtggtttcccagcctttatgtacgccacctaatcctcctgttacgaagaatttaatacctgcaaggtgagcacaaatcattgtagaagcaaccgttgttgcccctaattttttagacgcaataatctgtggtaaatcacggcgagaaacttttgcgatccctttgctgctaccaaataactctaattcatcatcagaaagaccaatacggattttgccgtcaatgattgcaatcgtcgcaggtacagcaccgttatcacggataatttgctcaacttcccttgccattgcaacattttgtggatatggcataccgtgagaaataatggtcgattctaaggcaacaatcggcaagtcttgagccataccacgttgcacttcatcagataaaataaggtagttattcataataatgctccatttcggtttctaattgagatttggttaaatttggtcgaacagtaaattccgactgaattgtatgataggcgttggttaaaccagctaagatcgctttgtcttgctcataattattaagccaagcataaataaatgctccactaaaagagtcgcctgcacctgtgacatcaatcactttgtggctatccatttttttaacggaataccaacgggtttcatcctgagatgcactcaaaatagctttagaacctgcggttaatacaatttgttttacgccttttgctaacaatattttagcggcttcttcaattttttgatcggtatctaatagcatatctaaataggctgcaagttcccctttattgatgattaagcaacttacaccttgtaaatcttgaggaagacgatccattttcggttcggaaacggcaatcaacaccaaaggaatgtgataaccttcggcacttttgcaaaggtattcaatggtcgcttttgggcaattcagatcagccacaatacaacgagcatttttaattaatgcagtgtgtttattcagggcttcaggggttaagctgtcataaatcgacatatccgctaagcctagatacatttcgccttctttgtctagtaatgcggtataacagcctgtagattgtccttctacggcaatcacattattcatatccataaactcagacgagaaggatttaattctctcccattcaggatcgttgccaaccgtagaaataaagctcactttctgcccgagtctgcctaaattctcagccacattacgagcaacaccgccaatcgttgttgtggaatttactgggtttgacgtataacctcgaagttcttcgtccgttttaatttttttatcaacattcgccgcaccaatacataaaatagcgctacgctcattaagaacataagctctgcctaataaatattctttttttattagggcggaaatgatgttggcaatcgctgaacgagataatcccatatattcagcgagttcttgctgtgaaatgaaagggttttgacgtattaaatctaaaatcgttttttcgttctgattcattgccgaactccattaggacaaatgttttaacgaaaggacatttgtcatattattaaatccattagaaacagcgtcaatgtctttttcaaaaatttgtgaacaagctcacaaaaataaagactgaatcctgttcagccttatagagtattgcaaaaaacttgaagaatctaaccgcttgtattattgaagtcgtttaatcgcatcaatcacgagatcccaaaaacgttctcgatctaaaacttttgccacataagtgttacattcttttggcggataacggaaatctgctaccgtcattccaagtgtatgtgttcctgttaattcaatattcacagggactttttgtgtttcgataagcgtcggatcaatcacataagctacggcacaaggatcgtgaacaggtggataatcaaacccttgggcctgtttatacattttgccgaagaagtctaacagctccaccacaaatttggctaaagcgtttcgagaaactttttccaaggtttgattgccaaccaccgttgttacagccaataaatcaatatctggattgccgtaagcaagcaaaatggcaatagcatcatcgtgtccaggatcgcaatccaaaataatttttttacgcatattatcttcctttagttcagtaaaaattaccgtgggtaaactacaataactctaactctataaggtgtaaaagaagctggcgtgaaaaatgagagctacttcacatttttgataaataaagtccattttctgtcaatttattttttaactatgtaaaaagttaaagatcttagtttgaaaacttggtatattgtgcagcccatcatttttgatgagttagttgttataatcactataacatttatcatatatctcttctctttctttgaatggagtccttaaatgggtacgttaaatagtttatttggtatagttgttctattaggaatagcttttcttttgtcaaataacaaaagagcaattaacttccgcacagtttttggtgcattagcttcacaaatcggtattgccgcattaattctttacgttccagtgggtcgtaatgcattaggtgcaatggcagagggggttgctaaagtgattagctatggtaacgaaggcgttgctttcttatttggcggtcttgttagcgataaaatgtttgaagtctttggaggcggtggtttcgtcttcgcattcagagttcttcctatcattgtcttcttctctgcattaatttcattactttactatgttggaattatgcaatgggtcatcaaaatcattggtggtggcttacaaaaagtacttggtacatctcaagcggaatcaatgtcagcagctgcgaatattttcgcaggtcaatcagaagcaccattagtggttaaaccttacatcagcaaaatgactgagtcagaactttttgcagtaatgtgtggtggtttagcttctatcgcaggttctgtaatggcaggttacgcaggtatgggggttccacttacatacttgattgcggcatcatttatggctgcacctgcaggtcttttattcgctaaaattattcttccacaaacagaaaaattcaatgacagcattgagaacgttgaattagaaaaaccagcaaacgtattagatgcagctgctgctggtgcaagctcaggtatgcacttagcattaaacgtaggtgcaatgttaatttcgttcattgcattaattgcattaatcaatggtgttttaggcgctgtcggtggctggttcggttatgaaggtctaaacttaggtctaattcttggttggatatttaaaccattagcttgggcaatcggtgttccttggaatgaagctgaagtcgctggtcaaatgatcggtcttaaattagcgatcaatgagttcgtgggttacttagaatttgctaaatacttaggccccgaagctccaatggcattaacagacaaaactaaagctatcgttactttcgcactttgtggttttgcaaactttagctctatcgcaatcttaatcggtagtttaggttctatggcaccaaatcgtcgtggtgatgtagctcgcttaggtatcaaagcggtagttgcaggttctcttgcaaacttaatgagtgctgcgattgcaggtctatttatcggaattggtggtgcggtttaacactctcaattcttgaacgaaacaccacaggaaactgtggtgttgtcgtttatggcaaagttaaacgattgctttaagtaaggaataaagaatgagtttaaaatctattgcaaaacaagccttatctttaatggatttaaccacattaaatgataatgacaccgatgaaaaagtggtaacattatgccaacaaggcaatacgctatttggtacgcctgcagcggtgtgtgtttaccctcgttttattccagttgctcgcaaaacattaaaagctcaaggaacagaacaagttaaaattgcgactgtcaccaatttccctcacggtaacgatgatattgacattgcggtggcagaaaccaaagctgcggtggcttatggtgctgatgaagtcgatgtggtttttccctatcgtgcattgatcgcaggtaatgaacaagtcggttttgagcttgtcaaacagtgtaaagcggtctgttctgccaataatgttgcattaaaagtgattattgaatcaggcgagctgaaaacagcggaattaattcgtaaagcgagtgagatttcaattaaagcaggggcagattttatcaaaacatcaacgggtaaagtgcctgtgaatgctacccttgaatctgctcatattatgctagaaaccattcgtgatttaggtgttgcagatagcgttggttttaaagccgctggcggtgtaaaaaccaccgaagaagcagagcagtacctcgcattaactgctgaaattttagggcaagattggattaaccaagctcatttccgctttggtgcatctagtttattagcaaatttacttgctacattaaacgatgaacaagtaaatcaaaatgtaacgggatattaatctctcaacaaacaaagaggaacagactatgactccacatattaacgcaccagcaggtgcatttgccgatgttgtattaatgccaggtgacccacttcgtgctaaatatatcgctgaaactttcttagaaaatgcagaacaagtcactaatgtccgtaatatgttcggttatactggaacttacaaaggtcgtcgtatttctgtaatgggacacggtatgggtattccatcttgctcaatctatgcgaaagaattaatcaccgaatacggtgtgaaaaaaattattcgtgtaggttcttgtggtgcagtacgccaagacgtgaaattacgcgaagtcattatcggtgttggtgcttgtactgactctaaagtaaaccgtatccgtttcaaagacaacgactttgcggcaattgctgactttgatcttactttagcggctgtacaagcagcaaaagcgaaaggcatcaatgtgcgtgtaggtaacctttactctgcagatcttttctacactccagatgtagaaatgtttgatgtaatggaaaaatacggcatcttaggtgttgagatggaagcggctggtatctacggtgttgctgcagaatttggtgcaaaagcattaaccatctgtactgtttcagaccatatccgtacgcacgaacaaactaccgcagaagagcgtcaactaaccttcaacgatatgattgaaattgcgttagagtctgtgttgattggtgatcagcaaggttaattaaaggcataccccctgattgattaatctgcatttttgtgaaatgaagtattacaataatgcggattttatcataactgtgccgtaaagttctctccttcagaacggagatataagatataaacggtgtgggtcgtttcaaatctaattaatcaggtatttgttgttgcttgatgtattggtgaataatgaatgggggaaccaccgcggctgccagcaaattgtgtttaatttcagtttcttcttttcatagatcaaatataaaatgtggaaaaatcacgctctaaactttgttaatgcaattacgcaaagactttaagttcgagataatgcccaacggcgagcaaatccgcataattaagcagttctgcagctatgctagggcatagtagacaaaatgcttgctaatgaatatttttaattattcttagcaactctttttatttaaaaaatcctttataaacataatgttatgttttttcattaatcctgtatgatgcgataatttttcctttagttgcccaaataatttttcaagtctatttgtcgttttttcgatatttaaatcgtcatgcttttcataggtaaatagataatccatataacgtttaaaactatgataagcacttcttacattccgatgtttataaggataatagcccttttcattcggtttctgaccgttcttctaaaaatgctttatgttttaaataccaatgatgtaatcgtaaatagacgtcttttttagaactctgtttaagcgttaatgctattgtttttaattcttttccagctatagattgatgctttcttcttaattttcgcatcacaatagctaccatatgaaaatggtacatttgcgtcggtgtatccaataaatctttcaataaacctcgcctgccgtcgcaggtaattgattgaatgttatagcctttcatacgaagtgaattgaacgctattctgtaataaacatctttttccgttttgatgacacgatggtaaaccacctttttagaaagcgaatccatcaggactaaaataccaaattcacgaccaaagaaggtggtatccgcaataatatttaaatcacgtgatagtggtggatttaatttctttttaagggtaaatgttttattacaagcattacattcatagcgttgaatattatttcttataccatgtttgcgaatgtcgctactgtggcaaaaatgacattttttgggttcataattcaaaaaagtggcttaaagcccgtaatataagactttaagccactttttagcaaccagtttgtctactatgcctatttatgtgagccttcagggtgtaaccctatgccctgatgacgctcttttaattttgcaatcacatcctgccaagcaagcccttcattatgtaataaaactgttaggtgatagactaaatctgtcgcttcacctacaagttcttcacgatctttcgccattgccgcaagtgccgtttcaaccccttcttcgccgactttctgtgcaattttcttcgtgcctttcgcataaagttttgccgtgtaagaactttcaggatcggcgtttttacgctcggcaagagtacgttctaatttgctaaaccacgtccaatcgccttcggattgggtttcaaactgatgaaaacaactttccgctccagtatggcaagtttccccaatcggatcggctaaaatcagcaaggtatcgttatcacaatccaagctcatatccaccacgtttaagaaattgcccgaagtttcccctttcgtccataagcgttgcttggtgcgagagaaaaaggtaacttttttctcggctaatgttttgcctaatgcttcttggttcatataaccaagcattaggacttcacaggtttgggcgttttggatgataacggggagaaggttatcgactttttgccaatttactttatttatcattctctatccttattttcctagcacggcaagccgtactaggttacgcataattgggtggagttgccactctttataaatttctttcgaaatattgttcatcatatttaatgccataatccgctaataaaaattttatttcatccacaaaattttggcttttatgatgctctttttgatttttaatgtaattgatgatttgtgctttttctcgttcgctataagttaacgcacaataacctttcgaccacgcataaaaatcaggaaaataattacgatgttgttctaaaaataaatgggtactatttttaaatgcttcacaaaatctgctacattgatggttgcttttaattcaacaaatagatgcaaatgatcaggcataccatttattcgataaagcaccacaccttgctctttcacataaccccaaatataacgatacaaaatttcttcgtgttcttccacaatagttggtaaaccatattttgtacgaaaaacaatatgataaagcaaccttgtatagctcattttatatccctaaacggtggcaaagccaccgaattatgcgtaaccgattgcgacaatgtcgctgtcggtactaacggcggatctcaacattttgctgagccaaataatccttcaactccccaatattgataatctgtttatgaaacacactcgctgccagtgcgccgtccacattcgcatcaataaacgcatctctaaaatgcaccatttcgcctgcaccgcccgaggcaatcagcggtacgtggcaggcttcacgcacttttttcagttgggctaaatcatagccgttgcgtacgccgtcttggttcatcatatttaacacgatttcgccggcacctcgtttttgcacttctgccacccaatcgagcagctgccagttggtttggcgggtgcgtttttcatcgccggtgtattgattaacccaatacttgcctgtttctttttcgaaccaactatcaatacccaccacaatggcttgcacgccaaagcgatctgcaagacgggaaatcagatcaggatccgccagtgcgggcgaattgatagaaattttatccgcaccgaaggcaaaaatctgctctgcatcgtcaatggttttaatgccacccgccacgcagaagggaatatcgatcacttccgctacacgctccacccagcttttatccaccgttctaccgtctgatgaggcggtaatatcgtagaataccaattcgtccgccccttcttccgcatagcgtttggcaagcggtacgatgtcgccgataatttcgtgattgcggaattgtacgcctttgactacttgtccatcacgcacatctaaacaagggattatccgttttgccaacattcgactgcctccgccacattaaatttaccttctaacaacgcacgtcccacgattacgccagccacgcctgtaccttttaacgcttgaatatccgcaagcgaaccgataccgcccgatgattggaaattcacatcaggatatttggcacaaatttctttatacaaatccacgtttggccccgccaacgtgccgtcacgagaaatgtccgtacataaaacgtgctgcaaaccgaccgattggaaatcgtcaatcaattcttccagtgacacgccgcttgcctcttgccaaccgctaatcgcaatgatttttcgaccgcttgtatcaatgttcacgtccaacgccagcacgaatttctccgccccgtatttattgaaccagcccttgactatctcacgttctttgaccgctgtggagccaatcaccacacggttcgctcccaccgtcaataaatccgccacatcttgctccgagcgaataccgccgcccacttggattttacatttggtcgccgcaataatctcaccgataagcgcggtctgtcttttggcaggatctttcgcccctgtcaaatccaccaaatgcaactgctccgccccttgtgcaaggtagctggcaaattgctcaatcggattatcgctataagtcgtctgtttggcataatcgccttggtgcaatcgcaccacctgcccatcaatcaaatcaagggcggggataataatggattttttcattgtgtttccttgtcctagggtagcaagctaccctaggttatgcatgatcctaccccgttggggtagatatggcacctagatacaacttggctaaatattataaatttctatcaataaagttagcatcaacttctacaccagcttcagccagtagaaattttgcttcatccataaaactcgtatgtttatggtgttctttttgatttttgatgtagttaataatttttgctttatctctttcgcaataagttaatgcacaataacctactgcccattcagtaaaatcaggaaataatgatttattttgttctaaaaataaatgcgttgtcttttttaacttccgcacaaattccgatacaggaatagtttgatgaatttccacaaataaatgaatatgatcgggcattccattcactcggtataaaacgctttgatgatcttgaacaaatttccaaatacaacgataaagctcattttcatattgttcattaatggcgtgaaccccatattttgtccgaaaaacaatatgataaagtaaacgtgtataactcattatattcctcaattaccccaaaggggtaagcttatacataaccaagggtaacttgttacccttgggttaatcgccccaactgatttctcaacgtccgctcaaacgcctctgccagcacttcgcaagccaacgctttttctaactctgtacgtattgcctcggttggtttttgtgcggcaagttggtttaggtgcataatattcaaatctggatacgggcgttgcaagcggtggattttgtctccttttttgcaaacgccggtttgaaccacacgcacataccaacctgttaaaccttgctctcgcacgattttttgcgtctccgcacactcagaattaagcgacaaccgctcgcaaggtttgcgtggttgcgacacttctaaaatcacatcgccgatttgataacggtcgcccacacaaacgttggtttcatccaattcggaaacgataaaattctcgccgtaaatcgccgtgttcttccaatcgaaatctttaccaataagtgcggtcaatttttcaaaggttttttccgccataaaaaacaacgctttatccacaccgccgtggtgggctttcaagcctacatcattaccttctgcccctaattcgtgaacggtgattttgtccactggttgcttgcgaatagcactttctaagattgttccgtccgcaaaagtgacgttttctaccaaaccgatttttaaggctaacacttccgccattaaatattctccacaaaatttttcaataactgcgctccatttttgcccgaacgttcagggtgaaattgcacgccataaaagcttttgctcgcaatagccgccgaaaaatccacaccatagttgctggtcgcaatagtattttcattcggcaacaccgcatagctatgcacgaaatagaaatggctgtcttgttcaatgctggcaaacaacggatgatccgccgcataacgcacacggttccaacccatatgcggcaacggcaagcccgtattcggaattaactctgttttgccgctcatcaggcgcaaagtatccacattgccctcggtggaaaattccgtcatcagctgcatccccaaacagatgccaagcatcggttgagtagcgttttggatggcttcaatcagctgacgatcctgcagatttttcatcgccgcaatcgccgtccccacgcccggtaacagcaatttatccgccgatttaatcttcgccaaatcacggctaatttccgcttgaattcccaaacggtcgaatgcaaattttacagaagacaggtttgcacagcctgtgtcgatgattactaggttggtcattaggtgatattccataatttatctttgccaaattttctcattacttcattcatatatatttctatattacctttcttttctaagattttcttcaatatatcttccctactgttaaatgtatctcttatatattcaaaaaattttttataagcagatacagcatcattatctctacctagataaatcaatgttaataaatctagtaattcattgtcattatattttaataaaaactcggttatactttgattaagacattgagcatttttgaaagctgaaatataatcaagattatttatccgttctatttcctctttatttgcaaggataaaattataaaaatttaaaaatttatctttacttaaaaaaataaaatctagatctaaacctattagagatgataaaaaatagtctttttttaccatctcatttatggcaatttctttgatacttctttttgattcaaccttgtacttatcacataattctgatattttttcttcaaaattgatatttttccattcaataaaatcaggaagttcttttgctattgaaactaactgtgtatatgtaaataatttcgtatactgattattatcatattcgctttttagtaaataactaaaatctctaaattttttcaagttttcatgatgctttttagacttaacaaatagcgatagaacagaaataagattttgatcttctagatgtcttttagattcattgctaaatgggtacctgaatgtttgtccggttggatctatatttccccaatcggttatatatttatctagaagatcaacataattatcgaatctctcatcaaaaattaacgctctactaatttcagaattagggcgccaatttgcaaaatgagctgcctttactatatcccataatttatttatgtcatgatgctctgttttatccagttcatttttataagcacctttctttctataaatataaattaaatttttaattatttcttttaaataaagttctattgaatgtctaatattgaaacatatagggtatacaataatatcttctgtaatattgacccttttcggtattgtatctagattattttttctattatctaatcttgttaaacattcatatataataaactctgcaccttcgaaaaaaccatcagcataatccgaaatagtatgatagccatttgttcctaccgtagcacatataggatctccttcttcataaaataaattatcttcattcatatttatttccccacccgatggttcaagcggtcaaatttcccaaaaactttgcaaaatctcaccgcacttttacaacgtaattgtaaggaggtactgcgtgcatccgctttaaatcacgctccgttttataatggacacacgcagtgtgtccctacatactccattatttccattttgtgcgaaatcacaacacccctttcgaactcggcaactcattcccttcaatgcgaatagcttgtcgtaaggttctgccgaacactttaaacaggctttcgattttgtgatgatcattgtcgcctttggctttgatatgcaaggtggcgagcatcgtgaaggcgatagattggaagaaatgctccgtcaattcggtgctgaaatcgcccactttttcacgtttaaattccgctttaaatttgataaatggacgacccgataaatccattgcacattgagcttgacattcgtccattggcaacacgaaaccaaaacgggcgatgccgcgtttgtcgccgatggcttgttttaaggcggtaccaagggcaagagcagtatcttcaacggtgtggtgttcgtcaatccagaggtcgcctttgcacgagatgttcatacggaaaccgccgtgggtggcgatttggtcgagcatatggtcgaaaaagcccacgccggttttgatgtcgttcacacccgtttcgtctagccacacttgcactttgatgtcggtctctttggttttgcgcaccacttccgcatagcgtggttggcgttcgccgatgttgatcactggctcgctaagtaatttttccgcaatcaaatcccaatttaatttttcaggatgatattgcaacgcgcgaataccaagattttccgccaactggacgtccgtagcacggtcgccgatgacaaaactggtggcagggtcaaacagttcacgcttaatatatttttgcagcaacttggttttcggcttgcggcagtcgcagttgtcttcaggtttgtgtgggcaaattaacacgtcatcaaactcaataccttgcgagcggaatagttccatcattgcattatgtggtttgtcgaaggtctcttgcggaaatgaactcgtacctaaaccgtcctgattgctcaccatcacaaagcgatatttgtgtttgagcttgagcaaggcagggatcacattcggctcaaatttgagtttttctaaactgtcgatttgaaaatcggttttgggttcgtcaattaaggtaccgtcacgatcgatgaataaaatagattgttgtgtcatttttgttctcctgttcttgccacatactgacgtatgtggttacgcatagtggcgatgcgctgcatcgctataaatcttgttcaaaaaatttttcgtttattgcaattccagcctctgtaagcaagaattttacttcttctacaaaatcagctgttttatggtgttctttttgatttttaatgtaattgatgattttctctttatctttttcgcaataagttagtgagcagtagcccctagaccacgcataaaattcaggaaaaagatgtttattttcatcaatccatttatgtgttgtcgttttcagtttttgtacaaactcagcgaccgaaagcatcgggtgcaattcaacaaaaagatgaagatgatcgggcataccgttgatccgataaagcacagaattatgttctcttacaaatccccaaatatagcgataaagcgcatcttcattttcttctaaaatacttggcgtaccatatttagtacggaagataatatggtataaatttcttgtatagctcatattttccctaacttaccgctacggagtagcggcactatgcttaaccacgtacgttagtgcgtggtatccgcacgatttatcttatactcccccaatcgcctccaccgttctttccaactcctctctcgtgccaatagaaatccgaatacaattctgtaaccccaatgctttgtgttggtcacgtaagataatccctttttcccacaaggctttgaacaccttttgtccgtcttggaattttaccagtacatagttagcctcagtgtcgaaaatctcaaccacgcttgggatttgtttgagttggtcgattaaccaggtgcggttttctagcacatcggcaacacgttgttgcatttcgctcaagccttgagcggttaaggcttgggtagcgatgtcggttacaggggtaggttgtgggtaaggagcgatgactttttgtagcacattaatcaattcagcattggcaagggtgaagccacaacgcaagcctgcaagagcaaaggctttggagagcgtgcggataatggctaagtgcggataatttggtagctcattgaccattgtcgcttgcgggcagaattcgatataagcctcgtccatcaccacaatcgctttgcctgcggtgatttgcaaaagtttgagcaaatccgaccgcttaactaacgtgcctgttgggttgtttgggctacacacaaacaccactttcacaccgtccaaattgcgttcaatttcaggtaaattaagttgaaaatccgcagttaaaggcacggttttaagtgcaatgccacaggtctccgccgacacgctgtacattccataagttggcggacagtacagcacacagtcggtcggctcacaaaaagcacggataatcagctcgatactttcatcgccaccacggctaaccaatacattttcaggcataacgccagcgtaggtagcataaccttcaatcaccgcttgcggttgcggttcgggatagcggttaaaagtgcggtcagttaaatcgaagtttggcgaaagcgcatattcgttcgcattcagccatacatcccccgaaccacccaaacggcgtgcggattggtatggggtgagggattggacattttttctagagagttgtgagattgtcatattgtatatcctgttgtagggacacactgcgtgtgtccgttaatattatttgcgatgatttatttttcggacacactcagtgtgtccctaccatttattttatcttcgccaatctaatcgacaccgcctgcttatgtgcttccaattgttctgctgctgccattagctccacggtttttgcgagatctttaaagccttgcggagtgagttcttgcacggtcattcgtttgctgaaatccgctaaaccgagactggaataagttcgggtgtagccgtaggttggtagcacgtggttggtgccgctagcgtaatcgcccatactttcggggctatatgcacctaagaaaattgagcctgcgttatcgagaaaaggcagtaggttgcgtgggttttccacttgcaccactaaatgttcaggggcgtaggcgttgctgatttggacacattgttgtaagtcttcggcaataaatacccgactatgcgaaagcgccttacaagcggtctctttgcgtggtaattttgcaagttggcgttcgatagcttgttcggtagcttgagcaagttcaaggctgtcggtgactaaaatcacttggctgtctgcgccgtgttccgcttgggaaagcaagtcgctagcgacaaaatcagggtcggcaaattgatcggctaacactaacacttccgaaggccctgcaggcatatcaatcgcagcgccattaagttgttggcttacttggcgtttagcttcggttacaaaggcgttgcccggcccgaagattttatccactttcgccaccgtttccgtgccgaacgccatcgccgtaatcgcctgcgcaccgcctacggcgtaaatcgtttcgaccccacataaattggcggtgtagagaatttcatcggcaatcggcggtggtgtgcagagcaccactttttgacagcccgcaattttagcgggaatggcgagcatcaacacagtcgaaaacagcggcgcagaaccaccggggatatataagcccacacgttgaatcggacgagtaattacttggcaacgcacgcctgcttgggtttctacatctacggtttgcgttttttgtgcttcgtggaacgttttgatattgcgataagcattttgaatcgcctgttttaattcatctggaatgcgttttgtcgcttgttcgatctgttcttttgataccacaaggcttttcagttcggttttatcgaattttgccgtcagttcaaataacgctttatcgccttcagttttcactaaattgacgatattttccaccgcacttttgatgtcgcttgatgcggaaatcgcagggcgggtaagggcttgttgtttttccgtttcggttaaattgttccaaattagggtttgcatattatcgttccttttttgcctagcacggcaaaaccgtactaggttacgcataattgagccgctctgcggctctgtttccccttctgagccccctgagcgactttaaatttttccgttaagcaaattcaaataaagcgaagatcaggagcgaagtagggttgcctttcttttggttacttttactcgcttcgctcgcccttcgggtcgttggcgagctaccaacgctcaaatgtttatacatttgtctttggcaacgcaaagaaaagtaacaataactactccatcatcttctcaatcggtaacaccaaaatcgagcttgcgccgatctctttaaggctttccatcgtttcccagaataagttctcttggctaaccacatgcatagcaactttggaatcatcgtgtgccagcggtaaaatcgttggattctcggcacctggtagcaaagccgtgatttcttcgagtttatcttttggagcgtgaagcataatatatttagattctgcggcttgttgtacgccttgaattcgggtgagcagtttatcgacgagggcttgtttttccgcggttaatggttcggcacgttgaattaagcaggctttggatttatagatcacttcgacttcttttaaaccgtttgcttcaagggttgcgcctgatgaaaccaaatcgcaaattgctgtagcaagtcctgcgcttggggcaacttctaccgaaccagttaatagacaatttttaaacggcacaccttgttctgccatatagcgtttgagtaagttaggataagaggtggcgatacgggcatctttgaaatcttgtacgccgttatatgtgcggtcacgatcaatcgctaatgacaaacggcaaccgccgaaatctaaagtacggagttttttatattcgacggattcacccgcatataaacgccctaattcctcttcttccaacacgttttcgccgataataccaagatcgaccacactgtcaaataccagtcctggaatatcatcatcacgcactcgcaaaatttcaatcggcagattttcggaataagcgattaaacgttgttcgttccaagtgattttcacaccgcactgtttgagtaattcgctgcaatctttgcttaaacgtccttttttctgcattgcaatgcgaagtctgttgtctgacatattgtgttccttctatttttattttgaataaagaaaaacccctcgaaagttgtcttccgaggggttgtgaattctgtgttgatcttaattcgctctcggaagtttatcttccgaacacgccaaatgcccgaaagattagtcggtcaaatggtgatgatagcgagtacgaataaaggtcatattttttctccaaaaatgaatggctcacaaaatacgataaaaagagaaagatgacaagctttttttgttttaaagataaattatttttatgataaatagcaaacgtttgcgtaaattgctataattaggctgaattgttcaatctaataggaatcctgccatgcaaatcagcctaaaaaaaatctattcgggtaaagtccgtgatctttatgaaattgatgataaacgtatgcttatggtggcaacggatcgtttatccgcctttgatgtgatcttagacgatccaatcccacgcaaaggcgaaattttaacccaaatttctaacttttggtttgataaattagcgcacattatgccaaatcactttacgggtgattcagtctttgacgttctctcaaaagaagaagcggaagcaattcaatacagagcggttgtatgtaagcgtttaacccctgttaaaattgagtcgattgttcgtggctacttaacaggcagtggcttaaaagattatcaaaaaacaggtaccatttgtggacttgaattaccagaaggtttagttgaagcgagcaaattgcctgagccaattttcacaccgtcaagtaaagcggaagtaggcgatcacgatatcaatatcagttatgcagaatgcgaatgtcaaatcggcaccgagcttgccgcaaaagtgcgtgatgctgcaattcgtctttataaagaagcgacagattatgccttaacaaaaggcattattatctgtgacaccaaatttgaatttggcttagatgaaaatggcgtattaacattaatggatgaagtattaactccagattcaagccgtttttggtcagttgaaacttacaaagaaggcacgaatccaccatcatttgataaacaatttatccgcgattggttggaaaacagaggttggaacaaacaagcgccagcgcctaaagtaccttctgatgtcattgaaaaaactgtggcaaaatatcaagaagcattggatttattaaccaaataagataacaagcggtgagatcttggcaatattttgcaaaatctcaccgttgtgttgagatattatgctaaatcgaataacaaaaattccacatcactgtgagtcgccagctctaaggcactttcttgacgaatacctaatgcatcacaccctgatagatttaagtcatcaatggttaaattccctcggacaacttgtagccaataatttcggttcttatctaaggtgatgttttctgagtgattattgggatattgataacgccataatttcatatcttgatagattttggatcataataattggcaaaagagaaagtgtggtagctttctaaccaatcaaaagagccatcacctcgttcatgtgctttacgtagttgtatcatcatttacttcttattattttgttagatacagtttacgtgatttatctctaagataaagtaagggattgttgataaattatttactaaaaagagataattttaaatttacttgatcttttctaacagaacagtattatctcgcctcttttttacttttgggttccctcaccccaattaacacaacttaaacaaaaaggaacaatatgaacgttattgactacttttctgacgagcagaaacgtcgctcgttgttactacttacacttttccatatttttatcattacaatcagtaactatttagttcagattgcttttgaaatcccagtaccatttacggatagtcgaattccaacgacttgggggacttttactttcccatttatctttcttgcgacagatttaaccgttagagtatttggtgcatcacttgctcgtaaaattattttggcggtcatgtttcccgcattgattgtgagctacgtgatttcagttattttctttgaaggacaatttcaaggctttgctacgttagctgagtttaatacttttgtatttcgtatcgcattggcgagctttgctggctatgttgttgggcagttaatggatatttttgtgtttaaccgattacgccaaggaaaaacgtggtggttagcacccgcaagttctactatctttggtagccttattgatacctttgtcttttttgctgtggctttctataaaagtagcgatgaatatatggcggaacattggtttacgattggtactgtggattatgcctttaaactttttgtaagtttattacttttcctcccactttatggcgtattattgaatttcttaattaaaaagctaaatttagccgttaaatcataatgtacaagcggttagttttggtaaaaatttgcaaaaactaaccgcttgttgatccgtcgtgaattatcttgctaaagagagtataatcttttcgatattaattttaatgagatgtaaaaatgaaaaatattccgattagaacacctgaagaaattgagaaattacgtgttgcttgtaagctggcttctgatattttggtgatgattgagccttatgtgaaagagggtgtaacaactggagagctagatcgtatttgccatgaatatattgaaaaagagcaacaggctattcctgcatgcttgggttatcatggctatccgaatgcgacttgtatttctctcaatgaagtggtttgtcatggtattcctcatccagataagaaattaaaaaaaggtgatattctcaatattgatgtcactgtcattaaagatggctatttcggtgataattcaaaaatgtatgttgttggagagccgagtgtgaaagacaaacgtttacttgaggtgacgctagaatctctttatatcgcattgcgtaccgttaagccaggtatccgtttaaatcaaattggtaaagttattcaacaatatgttgaaaaagaaggcttttctgtggtacgcgaatattgtgggcatggtatcggtgatgaattccacagtgatccgcaagtgctacattattatgctgatgatgagggcgttattctgcaagaaggtatggtgttcaccattgagccaatgataaatgcggggaaaaaagaaattcgcttaatgggcgatggttggactgttaaaaccaaagatcgtagtcattcagcgcagtatgagcaccaaattgtgattacaaaagatgggtgtgaaattttaactattcgtgatgaggaaattgcgtcaggtagaattcaacgttttatgaataataattaatcatatagatgaagaaaaatagggcatagtagacaaaatggttgctaatgtttattttctctaaatgttagcaactctttttatttaaaaaatcttgtataaacaacatcttactctttttcgttaatccattgtgattatttaattctcgcttaagttcactaaataacccctctaagcgatttgtcgtttttctatatttaattcagaatgtgtttcatagataaaaataaaatccatgtaacgctttaaactggcataagtacttcttacattgtgatgtttataaggaaaatagcctttttcattggctttattacttagaattatgagagaactgaagctgcaattatctgctcacaacggattaatgaaaaagagtaacacactgttttacaagactttttaaatagaaaagtcgctaatatttaaggaatacaaacattagcaactatttcatccacctatgtgttcaacatgagtaaaaagaatttaacagacaaagtatgtgattgatataagattcatttaaattcataacgaggaattgtttctagtctattcatctcatttatatgcacacgggcccccactgttgcatgagcatcgtacttcctatttattgttactaattcaccattgtctttttttatagtaagtttaactgaatcaaaagatagatattcgctggttacaatagttgcattaccttcagatgtatatttttcagccgtacacgctactgatataatgcctattaataaaatactggataactttttcatataagccctttgtataaaataagccaattttaaagaagtgacacatttaaatcagaatttgaaccaacaatttttacacgtttaccagggataaaaccgtcttcttttttctgaactaccacaatttctttgccgtcatctttacgaatcaccatttctaaagaagcaacttggctcattttttcttcaactttgctacctgcaatagaaccagccatagcaccaatagttgctgcgataacttgtcctcgaccgcctccaatcgtagagcctgcgataccgcctaaaacaccaccaccaacagccccgataacgcctttattatctgcctgaattttaacttcacgcacagataaaatagtaccataactcactgaacgagcttctttagcttgatcaccacgatatacactaccactatatatatccgtatttgcacaaccaacaagggttaaacttgtcactaacgctatggctaaacccatctttttcatattattctccaacaaaaaatttaaaggttattttcagaaaaaacgattgtatttatatcataagggtgcaatttaagacagcaaaaattctgataagttgcatttatgagtgaaattgccacacttggattaggtaaacgttcgccttcgacttgtggttgactgattttgatctttaattcgggattagcttgcaaagaaaattgctcatctatccgcttacaccactgctcaacgttctcgttttcgtacattgggataacaatttcaatatgctcccagccttcttctggatagcttttacctttagggaacggcaactcaatcacagaaacggcttgtccgcaaaaatgcagaggctgatttagagtaaacaaacctatcgggcgaccattaacttcactctcttttaatagcgttgaaccagtcagtagcattgctttccattgtttagcaagctcattgctattcattcgtactgccagatgatcgatctgatattggctcaaatcaatctgagcaatcttagcaatctgcgctatttttcgctcaaattcagcaagttcaccaaaacaagcggttagatttgtgaaaaagtttgcaaattcggagcatttatcagtattttttagtatcattgcacacattttttagtattagaaataggtataaacgtgaatattcaacacattctatcggaaaaaatcaagcaagcaatgattgtcgcaggggcagagcaaaatgttgagccattagtgcgtcaatcaggcaaagtccaattcggtgattatcaagcgaacggcattatgggggcagcaaaaaaattaggcttaaacccgcgtgaatttgctcaaaaagtagtggataacgttgatttaaacggcattgcagaaaaattagaaatcgcaggcccaggttttatcaacattttcttagccccaacttggttagctcaacaaacagaaaacgcattcagtggcgataaattaggcattcacttaaatcaagctcaaacggtagtggtcgattattcatcaccaaacgtcgctaaagagatgcacgttgggcatttacgttccaccattatcggcgacagtgtagtgcgtgctttagaatttttaggcaacaaagttattcgtgctaaccacgtcggcgactggggaacgcaatttggtatgctgattgcttacctagaaaaaatggaaaacgaacatgcgtctgaaatggaattgagcgatcttgaagccttttatcgcgcagcaaaagagcattatgatagtgatgaagtctttgcagaaaaagctcgaaattatgtggtgaaattgcaaagtggcgacgattattgccgtacgatgtggaagaagttggtaaacatcacaatgcaacaaaaccaacataactacaaccgtttgaatgtgacgcttactgaaaacgatgtaatgggcgagagcctttacaatccaatgttgcctgaaattgtggaggatttaaaagcacagggtctagccgttgaagatgacggggcgctagtggttttccttgatgaatttaaaaataaagacggcgatccaatgggcgtaatcgtgcagaaaaaagatggcggtttcctttacaccaccactgacattgctgctgccaaataccgctacgaaactttaaaagcagatcgtgcgttggtcttttccgacactcgccaaagccaacatatgcaacaggcttggttaatcactcgcaaagcaggttatgtgccggacagcttcagccttgaacatcacaacttcggaatgatgttaggcaaagatggcaaaccattcaaaacccgtacaggtggcacggttaaattagcggatttacttgatgaagccgttgagcgtgcagaaaaattaattgcagaaaaaaatccagatttaaccgctagtgaaaaacaagctgtggtggaatccgtggcaatcggggcggtgaagtactccgatctcagcaaaaaccgtaccacagactatgtatttgactgggataatatgttgagctttgaaggcaacaccgcaccttatatgcaatatgcctatacccgtgtgcgttcgatcttcagtcgtgcagggatcgacccgaacagcttaacgggcaatatcgttttaatcgacgaaaaagaacgcaaccttgcgattaaattattgcagtttgaagaagcggtgatggtggttgctaaagacggcacaccgcacgttctctgccaatatctctatgaattagcaggcattttctctagcttctacgaagcctacccaatacttaatgccgaagaaagtattaagcaaagtcgcttgaaactcgcccacttaacagcaaaaaccttaaaacaagggttggatctgttgggtattaagacggttgagaagatgtaaggcatagtttgtaaaaaatgatctgcaccccaaaagttggactaaacaaccaactaattaaggtgcagatttttatggctaaatacacccaatcttttaaacaacaagtgatcgaattttatcttcaacataataaaaatcgctcattaactcgtcagcattttcaggttaaggaaaccatattaagatattggattaatcagtataatcacgcctcgtgaaagaactgcgccaccaatttccgtttgagattttattgcaattggttgatttaaaacggagtacgttcttttatcatcttgctgaaaaagacaataaaaatgcagcgattaagcaagaagttatcaaaatttatcacaaaaatgacggtaattacggttatcatcgtattatgctggaattaagaaaaatatagctgattaaccataaaaaagtccaacgcttactgcaacagcttggtttgaaagggaaaaacaaacgcaaaaaatatcattcttatcgtggtgaagtcgacaaaattgcagagaatttgctaaaacagaattttcacactacagccccaaatcaaaaatgggtcactgatgtgagtgaatttaagtgtgcagaaggtaaactttatctctcgccgattaaggacttgtttaacggtgaaattattgcttatgatgtggcaagaaacccaagtttcgagcagataagccgaataatgaaacgagctgtagcaaggcttgacggagcaacgccgatactctattctgaccaaggttggcaatatcaaatggcaagttatcagtcgattttgaaacaaaacggcatcgtacaaagtatgtcgagaaagggaaattgtttggataacagtgcaatggaaagtttcttggggcgtttaaaaacggaatgttactttggtaaacggtttgagacctttgagcaactggaacaagctattcacgaatatattcattattacaatcatgagcgtattcaagtaagattaaaaggactaagccctgtggaatacagaactcaatccttgaactaaattagtctaactttttggagtcagatcaatattgattctgaatggatttttattgatagcagtgtcatcaaggcttaccagcattcaacaggagcaagcggtcaaaatctgcaagcgattggtaaaagtgtggcaggtaatagcacaaaaattcatttagcggtagatagttgtagaaatcctattgattttgttctgacggggggaagttcacgacagtaaagctgcgcctgagcttgtggcattgttacctgacagtgagaccattgttgcagacagaggttatgattgtgaagccttccgagcacttattttgacaacaaaagcagttccggttatacctcgcagacgaaattcaaaggtgggtaatcaggatatagactggtatttatatcgttattgccatttagttgaaaatgcgtttgcttttttaaaacaataccgagccattgcgactcggtacgataagttagcaagaaattatgcggcatctctagcaatgatttgttgtattcgttggggggagattgttgtttggttaagatttaaactcaaaagttcaacagcccctaataaagattagttaaattagttgttaaaattcagcagctattttaaagatctaacgaaattcagttataattccatcaacttttttccattgacctaaaacaatgacccaaacaacctatttcgccaccgcagcgcgtggctttgaagaaatgttaaaaacagaacttgagcagattacgcacgcacaatgcaaagtggctcaaggcggtgtgcatttcaccactgatttaaaaggggcgtatcaagcgttattacatagtcgcttggcttcccgtattttattgcccttaatcaatacgaaatttttcagcgacagcgatttgtatgcgtctgtggttgcttacgactggcaaagcattttcgatccaagagatacctttttcgtggattttaacggcacaaaccgtgaaattcgcaacacacaattcggtgcaatgcgagtgaaagacggcattgtcgattattttgagcgtaaaggttttgctcgtccgacagtggataaaatccgtccagatattcgtttacatgcctatttaaaccgtgaagaattgattatttctttggatttaagcggtgaggccttgcatatgcgtggttatcgtgaagaaacagggaaagcaccgttgcgtgaaaccttggcggcggcgattgtgttgcgttcgggctggcaaaaaggcacgccactggtcgatccgatgtgtggctcggggaccttgttgattgaagcggctcaaatgcaagcgaatattgccccacaaattaaccgtattcattggggatttgatagttggaaagggcatcagatcgaattgtggaaaagggtttggcaggaagcgaaagagggggaaatcctgcccccctccgccttcggcacctccccccgcgagcagggggaggaaagcaaagtgctgttcttcggctttgaccttgatcaccgagtgctacaaaaagctaaacagaatgcgaaaaatgcaggggtggcagatttaattcagtggcaacaaggcgatgtgtcggcgttgaaaaatccgattgcagagcaggtggggacggtgatttgtaatccgccttatggtgaacgactaagtacaaccccagcgttaattgcgttgtactctgtctttgggcaacggttaaaacagcaatttgcaggttggaatgcctccatttttagtggcgaacctgaattactgaactgcttacgtctgcgttcagctcgtcaatttaaggcaaagaatggaccgcttgagtgtgtacagaagaactatttgatcagcgaaaatgcagacaagcggtcagatcttgatgaaaatctgcaatttagccaaaacgcacaagttgcccctgattttgctaatcgtttaaccaaaaatatcaagaagatcgaaaaatgggcgaaacagcaagggcttgatgcctatcgtttatacgatgccgatctgcctgaatataatttggcggtggatagatatggcgatcatatcgtggtgcaagagtatgccgcaccgaaaaatattgatgaaaacaaagctcgccagcgcttgcttgatgcggtatctgcgaccttgtatgtcactggtgttgaaacgaataagttagtcttaaaagttcgccaacgtcaaaaagggactaatcagtatgagaagctggcgaataaaggcgactatttcttcgtgaatgaatatggggcgaagctatgggtaaacttgacggattaccttgatacaggcttgttccttgaccaccgcttaacgcgtaagatggtcggtgaaatggcgaaaggaaaaaccttcctaaatctgtttgcctacacgggttcagcgacggttcacgcagcgttaaatggagcaaaatcgaccacgacagtagatatgtcaaacacctatctcaactgggcggaacaaaatcttgagctgaacaatatttcactacgaaatcaccgcttgcatcaggcagattgcttgcaatggttagcggattgccgtgagcgttttgaactgattttcgttgatccgccgaccttttctaattcaaaacgaatggaaaacagttgggacgtacaacgtgatcatattgccttgatgaaacagttgaaacgcattttaacggcaaacggcacgattgtattctcgaacaacaaacgtggctttaaaatggattttgacggcttggctgaattaggattaacggcggaaaacatttcgcacaaaacattaccgttggattttgagcgtaatccgcatattcataactgctggattgtgaaacattcggaataaattatgttagatattgtgttatatgaacctgaaatcccacaaaatagtgggaatattatccgtctttgtgcaaactgcggtttccgtttgcatatgattgagccacttggctttgcgtgggatgataaaaaattacgccgctctgggctggattaccacgagtttgtcgatattcaaaaatataaagactttgatgattttcttgagcgagcaaagcctaaacgcctttttgctttaaccaccaaaggcgagcctaatcatagcgatgtgcagtacgaattgggggattttctgatgttcggccctgaaagccgtgggataccgaaagcgattttagatagtttaccaatgtcacaaaaaatccgtatcccgatgtgtaaagatagccgtagtatgaacttgtctaattccgttgctgttgtggtgtacgaagcatggcgacagtttggctatcaaaatgcagtgccaaggcaagagatttgaattatcggtgtaatagacaaaatagttgctaaaaagtggctcaaagccttataatacaaggctttaagccctattttttgaaatatgaacaaaaaactgcccattttgccaaagtcagaaaataaagaaacatgatatacaaaataatactcaacgttatttttgtaatgaatgttataaaacgtttatcttaaaatctaaattagatccaattaaaatttggactgattacacatccggaaaacaaacctatcaacaacttgctattaaatatcattgttcaattcaaagatatattgataaatctcctaaaacagctttaaaaccacctttaaatcgatacttgaacatcattatggatacgacattcttcggtcgttattttggtgtattagtgttgatggattcaaataacgtcatttctcattattttgtgcgaaccgaaaaagatatttactacaaacttgctctgaataggttaagagaaaaaggctatatcattcaatcgattaccggtgatggtagacgtggtttgatgaaagatttaggggctgacgtagattagctagtatgctaacccacaaaaatgaagataactcattgtaaattaaagaaatctatacagaagaaactccttgaattttttatgttagaagtaacagctcgatcagccgcagatttgctagttattcagcccaattcagcgatcctgttttaccgaaaaatccgtgaggtcatcagttatcatttagcccttgaagcagatgaagtatttgacggacaaattgagttggatgaaagctattttgacggcactcgcaaaggtaaacgaggtcgtggagctgtgggtaaaactgctgtattcgggcttttaaagtgtgatggtaaggtgtataccgtcgttgtaccgaattcaatctgcgacacttttactgattattcgagaaaaggtgaagcctgacagcattgtttacaccgatttttatcgaagctatgatgttcttgatgtgagtgagtttaatcattttcgtatcaatcacagtactcatttcgcagaaaaacaaaatcatataaacggaattgagaatttttggaaccaagctaagcgtcatttacgcaagtttaacggtattcccaaagcacattttgagttgtatttgaaggaatgcgaatggcgttttaatcacagtaacttaaaatctcaaatttccattttaaaacaattagttaagggtagcttaagttagttatctaggacagcccctaaatttaaagtaataggcaaaaaaatttattaaagttatatttttctttaatctatgttaagtccctagatagcaaaccatctagggactttatctttattaattaactaattaaccacttctcaactaattctggcgttgtttctttgtgtcgccacatactgcctaattctggctcagggaatttggtatggttatagctaacaaattcacggaaatcaaacacggcgtgtggataatcatttaacagcaaaaatgccttgtagccatcttctgaccagcagatctgaaaacggcgaggctcttttagggtttcgggttttacatcgctgacacgatagacaaataaactatcgaccacaggttgagcttcctgatgtaaatccattgcgtagaaataacctgtttcgccatcatcttcaaacatcacaactaaatgttcgtgcttaatggaatgagcgccgttgcgatagccttctcctaatacaatatgatcggttagaactgaatataacataaggtttcctcttttaattttggtaacattttaacatattctatccgataaatacttgagctacctttgaatgttagaaagtcttttcaaaagcgagtgtaacgttatgcattttgtaggaataaagcgtatccaaattgcttttctgtttcctccattccaaatttaatttaggtgtaataccccataaatgccaatctcgtttccaaacttgtgcaaaaactgaataaatatgatcttgacgaattttgccgagtggcaagataccacctagtatcgcttgatgtttaaattggcgatgggtaaaagagaaatttaattttgttgaaatcccaaaagcgtattcttgcaaccaacctaaacgtaaattctgaatatcagagctgtattgtcgatcttgtaagcgttgctgagaaaaagctgctccgagataaaaaatttgttcgggatttcgataccaaatcaacgtcgttgaagctgttcggatattaccagcctgcgggttatctttgaaaaaacggcgtttttcatattcaagtgcagtttgattttgccaattttgtgaaagccaaaaactgtaactgatttctgcaccattcgaccaatggaatgggttaccgccataccagcgtttttcataaaagggctgtaatcgtaatattgtatcgctctttttgtaagcataaccgataaaagtgcggctaaagagatcgtcatattggtggttatcccaataggttttgccgtaggtttcattactcacgccaagataatgcgaacctattagattaaaatcacgattaatgcccaaattataggcaaccccctgtgctttttgcggcaacattcctacaccttttacaaatcccgtattttcaatgactgaagatgatgaaacattttcgacattatccgttttaagataggaaacgctcgcatcaaattgccaactatttcttgaattgagagcatcaatataacgttcaataagttggtatgccgaagacggtagatttttgacactttttactttatcaaactgcactcttgctgcgctatcttgtcgatcggcaaagagtacttttgccaattccattcgaattgaatttagttcaggtcgttcgctcaatatttttcggtaaatacgaatagcaacgtcatagttatgctgtaaagcggctagcttagcttctgcataagactttaatgtcaaatcttgctgtggttgctgttgatattggtaaagtaaagattggatttgactgctattattttggtaaatagcttgttttaattgctcttcaagtgttgttacggaagcaaaaacaatattagaacaacataaggcgagtaaaaagaaagaacgcataagaatggtaaaagttatattcaaacctagcacgcaaatacgaactaggtttaactgctcaaagaattagtaacgaataccaccgaatgaagtatcgtagctgttatcaccactgaaagttgcaatacctgctgcttcttttgctccattaccgaacaagccaccttcataagtgccttcctgtaatagggtggttgctttgccgctgaaagttgtaccgtttaattgggttttgtgcaaggtaatatcttgcgcacgtccatcggttaataggctaaattcaactttgccatctaccgttttttgatcaaaatctacatttaatgtagttttaccacctttggctggctgccctgttgcaccacttacccaataagcatcgcctaagtaagttgcactacctgaaggtaaatttgttgcagcggttccttgatagcgaacttcttttagcgttttgctatcgtttagccaaataccatagaaagagtcattgttgtttttaccatacaattccccatcaacagttttagcaccaacatcccctttcgggctgttggttagatcaatattagtattatctggtgttgtcgctgtaccagcaccgccaccgccgccactacaagcagttaataacccagccaaaattgcagaaagaagtaattttgtcataagcacatcctttgataagtagaaataattagttttagccaattttagttaataaataagtaattgttagcagctttacttatctataactctatttttaagtaaaaaaatgcacaaaatgtgaatagatgagtattagcaaataaaaaggtcaaaatggcacagcttcctgcggaaataacagataaattaattgggcagcgtattcagcaaaagagaaaggaatttggctattcagcggaaaagttgtcagaatgtatcaatttatcccagcaacaactttcacgctatgagcgtggtgcaagtaaaatcaacgttaatcacttgattgatatcgctattttctttaaaacacctattaattggtttttccaagattgtattcctgcagaatttactgaaaaggaattaaaagagatagaaataaaccaaaaatgggatagcctgtcttgtgttcaaaaagaagcgtttatcacttttcttgaaacattaaaataattctgcgagagcttaataatattacacctatttagaaaataaacattagcaacaattttgtctactatgctttttaacttaagaaatataaaaggctcttataaattttttccaatattacataatccactgattaccagtggattatgaattgaattacacggtatatttaaaactcttttaatagatttacacttataatttcaagcagccttgatgtttccaaacaattctctcgccctttaataaagaaacgagaagtcatcgctttttcgccatcgttgaggaaaatctcaacaacagaacggtcaaagaagatctcgacattttccaatttttcaacttcgcaatggcgttgttcgccaaattgtttcatcagatctgtttggtcggtcgctgaacgatctaaggtgactagcccattttcataacggaaggtcagattttgcccctgttcgttatcaaagaaacggatcacaagcggttgattttccacattaaattgcaaataagcagtgtctaggttttctacttccgtaatcccattcacacttaacgacactttatcctgcaattgtgcataaatctctttgactggctgttggaaaactttgccctgtttaacggaaagctgacgaggcattgtcagcatagagtgccatttatatttatccgttggatacattaaatctggcaagccaacccaaccatataaaatcccttctgcattctgtactgtctgcggtgcataaaaatcaaagccataatctagctcttcaatatgttctgctgtcagcgttgcaccagttaattgacctaacgcataggtggcgtggtaattattttggaaacgtgtcgcttcacgtaatttaccctgtggcgaccaaacgaacagatctttatccgccaatttgaacaaatcggggcattcccacataaatacgttgctgttatcaaaatcattaattgcaatttcagagagcaaacgaggggtagcttctaggttgtccatttcatagagcaagcctgtgcctgttagattttcacgctgtgcgcctaatacaaaacgaattttgccttctgcggtaacaaaaggcttcgggtcacgaacgtgttccgtatagccttgtggtgcttggtcgataatacaacgcttctcaagtaatttgcccgatttatcaaaaatagcaatattttgatgtggcacacgctgattatcgcttgctcggcgcgtattgcccgtataaaacgcgacaatcttatcttgccataaaatcgccccacccgaataacagccgtgggactcaaacatttcatcaggaataagcggatccgcttcggcaaatgtttggaaatcctttgtcatcagatgtttccaatgtttcattccgtgcaacgcatcgtaaggaaaccattgatagaaaatatgatatttttcaccgtcaaaaattaagccatttggatcgttaagcaatcctgttggcggtgcaagatgataggtcggacggaaatcctgatccagttcaaccgcttgacgaactgcatcaagttcaccgacttcttgagcgtgcaggcttttgtatttaccttgattgaaaatgtgcatagtattttcctcctgtgagggtttagttccttgtacaacctgataacatcgtctacattcaaccccaaagatgttatttacaacattcttttggaaataaagacagataaatgaagcaaatgccatatcacacacagaggatttgcgatgccctttgattagggtttaaagaatcatagtaacccacagtataatttacatcattaatatagccttctgaccagtttttcataaaatttcctctatttttcaataaaaattaaattctttttctaatatttaccaacaaacattttctttaacgtctttcatcatcaaaatcatcatcttcgtcatcaaaaaattcgccgtcatcaccatattcatcttcatcactgttcggatcttcaaaataagttccccagccttcataaaccgcacccgatttttcgattaacggcagtagctctttttgttgagcggtaataagttccgcatctagtttaatttcgctaacaatatcgcacacaaacacgagatcgccattctcttcttccacttcctctgcttcagaaatctcataacccaacttataagcatctaccactaacttttcgagtttatcgaaatcgtgatgagcaatgtggtgttcgataatataaagggcttcaggatcgcttccatcggctaataaagagttgatgatttcatcggtttcttggcgtaattcggttaagttatacataagttatccctcttgggtttgagtaaaaatttcggcgaaccagctatctaatttagtcgcaagtttatcaataccaatacgatttaatgcagaataggcttcgacttgcacatcgccttgaaacggtaaaatcgcttcccgcaccattttgacggttttgcttctcgcactttggctaagtttatccgctttggtaagtagcaataatacaggcaacttcgcagataccgcccactcgatcatctgctgatcgagatctttcaatgggtggcgaatatccattaaaatcactacgccccgtaaacattcacgtttctgcaagtattcacctaaagaacgttgccactgaagtttcatctgctcaggcaccgccgcataaccatagcctggtaaatcgactaatttacaatttggttctacttcaaataagttaattaactgcgtacgccctggggttttagaggtacgagccaagtttttttgattagttaaggcatttaatgccgtcgatttccctgcatttgaacgccctgcaaaggcaatttccacgccacttggtttgattattcatttgcaacatgctgacaaagaaggctggggggaaatcgtcccattgcctgaatttagccaagaaaccttagcagaggcggaaattgcagttcgccaatggattgaaaagtggctaaatcatcaagacgattctttaacatcctatccaccgtccgttgcatttgggattagacgacaatgttaagtaggctatgtgataatgattaaatagcagcctgttcaagagacgatgcggtgtaaaatatcccatctaaatcaccgctttcatcagatttcccgcctattatttctaacttttttaataattgacaataaaagttgaaaaatgcttgttattttattctttattttatgtaaatgttgtttttttttttttttttttacaatggagtgggggcaggtatttttgagattcccccgcttaacacgtataaaagagctcaaatatgcacctcacattatttttagataaacagcaagataaatttaaattaaatcttttaagtctagtattactaagtatattttttagtccagtaggttcagcagcatatcttcaagatggggctggaggatcaaccgacgagggttctattggtattggtagagatagtagggttgggcctggttctattgttattggtcagttatcaaacgctgaaggtaggactgctattgcgataggttattttgcaagtgcactaccattgaaatctatcgccttaggcacagaaagcgttgcgacacagagtgaagcaattgcaataggttcaggtgctgtagcaagttcgatacaatctgttgctatcgggaaagataccagagcgagtgggtatcgctccatatcaatcggttatagtgcaaatgcagcatcagaatctatctccttaggtctagtctcaaaagcaacccatatagaaggtgtagcaatcggtgcgaaaagtacttcaaatggcaactatggtgtggctgtcggtagcagttctacagcttccgattatgccgttgctgttggtaaaagtgctattgcaaataaaacaggagcttccgcattcggtgaaaacgcacaagcaacggcggagcgtgcaacagcattggggaataatgcgacagcagataagaaaaatggcgttgctctaggttataaatccaagactagtcgtgacttagggcaaaggggttggataccaaatgatacaaattataatgttaacggaactacattatctgctacgcatgcagcggtagcagtaggtgatgacacctcctccgtcactcgtcaaattaccggtgttgctgcaggtacacaagatactgacgcagtaaacgtagcacaattaaaagcattgactttaaagatcagtggcgatgaagatacgaagggtcacacaacattttttaatgaaacgctctcaattgtagggggtaatggtattagtacggcagttgagcagggaaatggcaagacaaaaattacccttaaactgactcaaggtgagtttaactctacaactgatggcaaattgtcaaaaaagacaccaggacttgcaactgttgatactgtagtcaatgctgtaaatgatgcaggctggaaactgatgattgctaagggaacgggtggtgaagctactcctcttcctacagcacatcttatcaaaatgggtgatacagtgaaatttactgcaggcaataacattcaactaacccaagagaatggcaatatcaccattgctactaaaggtaagttaattgagagtgcggtaaatgaaataaatggcgatctaaaaattacctatacagatggttcgcatagcaccatcaaaaaaggtgaaaaaggagatcgtggcgagcagggactaagaggtgaagcaggtccgataggtccgatgggtccgccgggtcaaacaggtgaaatgggtcccgcaggtcctcagggccctgcaggtcctgcgggtgtagcaggggctcggggtgaaccaggtcctgctggtcctgctggtgctaggggagaaaaaggcgagaaaggtgaccctggtaaagcaggaccagtaggtccaaaaggagagactgggcaaagaggtgaacgaggagaacaaggaccgccaggaatagcgggtactccgggacctaagggtgagcgaggagaaacaggaccacaaggtgcaccaggtccagttggtccgcaaggtcctacaggtgctaagggtgagcaaggtcctagaggtgaacaaggaactccaggagtagctggtcctaagggcgatagaggtgaaactggtccagcaggtccaagaggagagacaggtcctgcgggtccaacaggtccgaaaggcgatacaggcccagcaggtcctaaaggagagcaaggtttaacgggtcagactggtccgcaaggtccagtgggtccacaaggaccgcaaggaatagcgggtgcaacaggacctaagggtaataaaggtgatccgggaccaaaaggtgaaactggtcctgcgggcccagcaggtcctaaaggagatcaaggtctagttggtccgcaaggtcctacaggtgctaagggtgagcaaggtcctagaggtgaaccaggtattcaaggaccaagaggtgaagctggtccgaaaggtgaagtaggtccagcaggtccgacaggtcctactggtgctaggggagaaaaaggcgacactggccctgcgggtccagcaggggctcagggtgaacaaggtcctagaggtgaacaagggactccaggagtagctggtcctaagggcgatagaggtgaagttggtccaatgggtccacaaggtcctgcaggtgctaagggtgaaccaggtcctataggtccagcaggacctaagggtgataaaggtgatgcgggaccacaaggtgaaactggtccagcaggtccgatgggtcctgctggtgctaagggtgaaccaggtcctataggtccagcaggacctaagggtgataaaggtgaacagggtgaacaaggaccaagaggtgaagctggtccagcaggtcctcagggccctgctggtgcaacaggtcctgagggtccagttggtccgacaggtcctgcgggtccaacaggtccgaaaggcgatacaggcccagcaggtcctaaaggagagcaaggtttaacgggtcagactggtccgcaaggtccagtgggtccacaagaagcgcaaggggttgaagcgggtaaaaatgtgaaagtgacttcacaaacgggtgcaaatgatcagaatatttacaaggtgagcgtgtctggagatttaagcgacattacttcaattagtaatggcgatacgaaagtatctttaggtaaagatgaacaaggaaatccagttgtaaatatgaatggtgccagaattaccaacattggagatggtagtgctgagggcgatgttgtgaatgttcgtcagctcaacacagtggtttcttcgatgaatgctggatttaatcaattgtcgaaagatattggtcgtgttgatgtcaatgcaagagcgggtattgcttctgctgtggcaatggcgaatttacctcaagtaaatttaccaggtaaaagtgctatttccgtttctagtgcacaatatcgtggacaagcagcttatgcaattggctactcaagagtttctgataatggcaaatggcttattcgagcgtctgttagcagtaatactcagcgggatactacgattggaggaggggtaggttttgtgtggtaatctagcacctataaattagaatttcatgctcaatgccattgttattttaacaatggcattgttttctatagtgggtttaatggtaggtttgaataaatttttgataggcattcaaaaacgtttcaaaatcttctaatccgcaaaaagcgatactttcttcatcatagaaactaaagccgttttcgacatcttcgatttcttcaaatgtcatatccagattatttgctttcaccatcacttcttcaatgttgatataaaggctatattctttaccttcaaaaatccattcgtagttttgatctttggtttggcgacaatgctcaatttcagcaaaaatagcggttaactcttttggatttggcacaatctcggtatttaaccaacgagcaaatgcctcgtgatccattgaacatttggcaataacgccgtgcatggtatgtgtaaattggtattccatcattttctcctttcaaacaagcggtcggattcgtttggttttttgcaaaatattataacgaagtgaccgcttgcaactacaacttaacctttcttcaaaatctcttttaaaaatcttgccgtatgggattttttatcttttgccacctcttcaggcgtaccttcggcgataatctgtccgccaccgctaccgccttcaggacctagatcgacaatccagtctgccgttttgatcacatctaagttatgctcgatcaccacaatggtatttccttgatcacgcaagcggtgcaatacggtcaataattgtttaatgtcggcgaagtgtaatcctgtcgttggttcatcaagaatatagagggttttgcccgtacttgtaacccttcacgccctacactaaagctgatcgtacattgctctaagcgagacgtttcaagcacccatttaccataacggcgagcttgcccacgagaagtacaggcaaacgcaacgattttcttcacgttatagccataacgcttaatcattgcatcatctgccacatactcaatcgctttttgatagttattgcgttcgtcggcatattccacttcaacggcggtaaaaatggatttaagcggtacatactggcgattaaatttaccgtcaataacgttcgcctgagtaaatgagcagacaggatcggcatttctgtcttgaatagcggttaattgcgtaccattccacatcacaatcgcacggaaaaccgacgccatatccgaaatcaccgaataagcatcacgttgctctgtcagccataaatttgccaccattctcggctcaacaccgccatagccgtctggtacttgttgatcgcagtattgagcaatctgatacaactggaatttatcaatgccataatcgcctaaacgttgccccaagccagctaatttgttggtgactaaatcgtaaaaaggcacacgggcagacaatcgcccttcgctgtggtgtaacatcatttgattaccaaggtaaatgcctgcgtgattagccacatcgctaccaatttgcagtaacacaatatcgccaagctggggctgtgcttcaaaatctaaccgctcaaagccaaagcggagcaagttttcttcatacaagttgcctgatttaaaccattcaaactcgtactccacatcgtcaggcaaatccaatcccgacaacatataggcatcaagtaagatattgcgacaatcttgcttgttattctcaaactgacgaccgacaagcggtgcgatagggcggaatttttgcaacttgccatcgcaaaccaaccaaaacggcagatttaaccgcacttggcattctctgtctgcggttgatagataaggcaaacctttctcggtgtctgaatcagggtgagaatgaacaaccgccacaatctcacccacgctttccgcccgaatccaatcatcaggtgaaatttcaaaatgattaatcagatcgacagccacattttcacaaggaaaataacgcaactcaccgcccttagaaacgacaaaaccgcaactttcgtgcgtttctgagcgtttggcgtgatataaaatttgttctgtaaaagagatattttgcattattgtatacaacctatttacaagttaagatttaagcgtatacttactgtatacaaaaaggataaccacaatgattctctcgtttaaacataaaggcttaaagctattttttgaaacaggttcaacagcaggtattcaagctaatcacgcttctaaattgcgtcttcaacttgcgacactagaaaacgctgaaactgtttctgcaatgaactttcctggttgggatttacacccattacaaggcaatcttgttggacattggagtgtcaaagtcaataaaaactggcgtttaacctttaaatttgagaacggtcacgcagaaattgtggattatcaagattatcattaaggagctgaagaatgagaatgtttaacccgccacatccaggcttattgctaaaagaatacctagataatgccgacactagcattactcaaattgctaaacaacttggtgtcactcgtgtctgtctatctcgtattatcaatgaaaaatcagcaataacccctgaaatggcacttcgtttaagtcagctattgcctaataccacacccaaattatggttaggtatgcaagcagattttgatttgtggcaattagaacagcgtgctacatttcacatagaaccgctatttgcttaagccccatactgcgtcgtacttggaaagcccccaaacggtaaaatggcattagccccgaatctcagcttgcaaccacgcaaacagtgggaacaagcgtcttttttcggatcggttgtcgggttatctttttcatcggcaacaggtccgcctgtgtagccacactccgcagagcgatatggccaaatacaggtatctgacgtaatcatcaacaacggtatgcgagcattatctgtttctgcgggtaaagccagctcaaaggtcgccacttcatcatttaggctttttaactgctcaatgatgaataaactcacacttttctgtgtcggatcggcttgtggattttgtccgttagggaaattgcgagcatcaaggaattgtgcatagactaaacgacgggtcacctttgccccaattccttgtccgaaatctgcggctaaagcggtgacaatgccgtacaagtttgagattgtcaaagtcggtcggttactcggcccttgaccgctaatctcaaaaccgtccgcattaattgggtaggcttggtattcgttaccttgccaccaaacattctgctgaccttgatttaagccattgtgaaagcgtaataactcccctttttgtgtcgggtcgctgttactgctgatatgccttaaatcaatttcccacagttcaatcaaggcattttgttccagttttggcagttcgtttgccattttttgaggtagggattttggcattacatactcctatcgtctaaattgaccacccgcacgagcaaaattattggtgatcgctttctgactttcgtctcttgcgattcctctcattgtttttaacaattccactgtgatatgagtgccatctggcgtttcttcttgagaaactttggcatctactgcattaccattgttgatgatttgaacatttacagatgatttacccgatgcttgatttcggtttccttgatttgctaaaaaggcttttaaatcttggttagtacggctatctacaactcgctcgccacgatctagcaaccaagttccttcctttggtatgctatcaatacctgagtgagccataccgctcaaacttatacttgtcagttgagaaataacactcatcccagccgaagccaccgcagccatatttgcgaatttctgagctggtgtcatcgctgttccatcgcccattgcctgcacaatcgcttgttgaagtctaaccattgaatctgcaactgcaaaagcttttgacatcgcaaacattgttttataaacaccagattgcttgcccattgattgtgcagctaaatcagccatttgaccaaatgcaccgcctaaattttgcaacccagcagagtaatttgataaatcctcaagaatcgttttactacgatattgttcttcaagttgattttttcttttcaaaaaatcttcgtgactaattagcatttgatcataccttgactgattttctgctagtttcgtagcttgctcattcttcattgcttgcatagggtcgaactctgctttccattggtcatagccgttcaccgcattttgcccagctaattgtgcctgtttatttccagcctcccaagtggcgttttctgtggcttttttcgcttggtcatgagttaaaagccctgctgcattgagttgttgaatatcttgtaaatgctcttttagctcgcgtgcatattgcaactcaggggcgaactgttctgctaattttgcacgttcattggcaaaacgttgtgaaatcgccaattttgctgactcatattcttcgtgtgaaactaccccttttttattatgctcttccaaacgttggaacattcgctgttgctcggcgtcaatttcttcaagggtggaacggctgtgtttgcgaacttcatcataaaattgaagccaactatcgcgcgcttttttaccaccgccgctattactcaaactttggttaataccctctgtttgcgtctgatctttgaacatcccttgtaatactttccggccctcaatcagtttatttaaggtttcgatagataaatcaatgcctttatccgctgcattcgctgcagtaatcgtacctttggcaatatcaattagcacttgattatattcagcgcctttatcgccaagcaattcatataagccggctaaaataaaggcggactctgcctgtccttgctgttttaattttgccacttcaagattttgcgctaccgttaaagcgcgttcttttaattttttaaacgcctcatctagatctagattgttctttactccaccttgcgccgcctctttctgttgttttatcgtattgcttaaatcggcaatgacgctatctgccgtattggcatcaacacctaagtttttcattttggtacgaaaatcatcaatgcttttgccatttgacaagaacacctcaccaagtgcggttaattggttggttaaaactgaaagatcgatatttttattttctcgaatcttttctaattccgcgtttaacttttcaagatcttgcttggaactttcagacagctccaaaccaaattgccaagcacttgtttgaatttgggaaatttccgcctgcactttggaaatttgctcaccataattttccattgcttgaatttgctcaaaaattttcaaggttaacgcgctttcacttaagccgtcataactttcttttaaacggttattcgcactctcggtatctaacgccgcctcttttgcctcttgtgccttttggctaaaataaaatagcgcacctgccgcaattgttgccgctcccatagggccaccaataagacctaatgcgccacttaataaattttttgcccctgcggcggcgttacttgcaatagacgcgcgttgagaggctgcagcaagattattcatagcagctgcctccgcattaataagccccgtaataacttgcgcttgttgagccattttagcctcaatcgctgctctagctttcttggttcgtactaattgcatttctgaattcaacaaattcattttggcttgtgcagccgctaattctgccgctgcttgggtttgtgtggctttcgcagcgattaaactcgcttgcgcttgtctgtgtgtttccactcgagcaagaaccaacgttgaaataaacttagcaccattgccagctgcaattgccaaaagtacaccagctaaatattcaaaattctgcgcaagaaaagaaatacctgtcgctaaattttctgtaatacctaaagtgcggttctgttcgtctacaaatttcataaatgcgttttccatttgttgcattgcaccaccaaatgaaatcggcatttgttcaaatttttggttaattttttctgttgagccattaaaggcgtcaaaaatcaatttagatgttaattgtccttcgcttgccagttttttcacttcagcacggcttttacccatgtattccgctaatacatcaagaataatcggggcggattccgcaatggttttaaattcatcaccttgtaattgccctgaacccaaagcttgcgacaactgaaataatgcacttgcttgagcctcagcactcacaccaccgacagccattgctttattcattgtttcagtaaattgcagaatgtctttttgtgcatatccataatcttttaaggcacgagctgaacgcgtatataatgaagttgtcgcctctaaacttccccttgtgcgttgggcaatctcaaataattccttttgcacttggttcatttcggtcatagaacttgtcacaaactgcacttgattgcgtaaagactgcattttgtccgccagcgctaagaggtgggaaatcccaccgcctattccggataaagctaataacgcttgtaaacgcccaaagcatttattcaattgttcagtagctgtttctgttctctttgctgcacgttccacattatttaaatctcgagtggatttttctgcaccatttgtgcggatttcaattgctagtgttgctaaatccgtcatagcatttctccaataaaaaatgcacgatcttgcgaaagtgcggttaattgtggtcatataaccacagttgaattttgtaccgttatctaatttacaggcataaaaaaccgcacataaagtacggtcaatttaatagcggtagctcaatttgcattttgtcttcaaagatttttagcgttgcttctaataatggctttttacctttccattcacttaaggctttaccgcataaacttgctaattgtttttcggctttatgttcaccaagtaaagagtagtattgctcaagtagtgtttggctaccttttgccaattcttccgccatataatcaaaggctttgatataagaaatcttaattgccattgcctttttggatttataacccattaccaaaagcataaagccatttttggttaaattgtaatatggagtaggtctaccattctgtaactcattgattttaaagcaaacctcaaaattgagttttgcaaagtcctcatcgcaattttcaataagagatttaatatcccgcaatacattgtcgtgtcgcttaccaaataccttcgctacaatttctgatgtagttacagtttgatgatctttgatttgtacaaattgtttaaaattttcagggtttgctaattgcatattcgtgtccttttatgattttatttgataataaaaaacccgaccatttctgatcgggttgaatttcaggtacaacaaaaaaccgcttgcatctaatgacacaagcggtttgatattgatattttttgcaaaatctatttaatgattacatattttacctgatttttctcggcatctttttgttgttgagcgtctaactctttcttcaatcgatccaaatagatcttgtttttataaagcccaattgcaacagaaccaataagggtgacagatagaccaaaaatcgtagcatgaaagagcgtaatatcttgagcaaaagcccctaatacgaaaaatataacccaactcatcagccaaccgatgaaaacggcttttacacaggaaaataagaacatatgcgactcctttttttgaaatctaacactacaccgattaaatttcaacaaatttacgctaccacttccctaaattgagctgaaagcgtccaaaagccttgttgttggtttgttttccattcatcacaacgaaatttcccttgtgttgaaccgtgcggagtccataaaaacgcttttacaccgccttgattatttaaaaagacttcaatttgttttattcggctttccgtgccactaaaagaaatatcataaatgcggagattgtgatttaatcctttgggtgctacttgctcgtaaccattaccaaacttaagtttcatcacctcaggctttttcgtgagttgcattccccaatcgggattaaagttaaaggtttccacactaaatctccgtattttgtacattcaggaaaatcacatcaagctgtttaattaccttgatttcccatattgctaactctatctgaagcagtctattccatgcctcaatctcagcataagtaataggagaaagccccatacctgactgtcgagaaagagatagctcatagaaaaaacccagcagataacttatcgctgggctaatttcgatattctcaagctcttcaggaacactaccagtctgctcttgaatagccaaaagatgttctcgcaaggtgcaatcagaatcctttggctttttgtctaattcaaattcttttttagcatataccaacaaatcatcaattagctcttcaagaactttcccaaatcgtttgaatgttcaagaatttgttcgataatccaatcacattccgttaataacattcgggcattttcctctgtaaacggcaattcttttttgtcgccaaattccacattctcccaaccaactatgcgatttaatgccagttcaacgctgtcttctttgatttcatccaattctttaaattttggatgacgggtgcgtgcattttccaattcgcgtttttgctctttgcgtaattgttttgcaaagaacttttgagcttggtctgattttgcactcacgacgtgaatgaatacccctaatccctctcctgtgacaggatgtgtcagttcaaaacggtatttttctgaaatactgtcttttgcaagatcttttaagttcattgtaattcctctctattaagccaatgtatcttgtacaatcattgtggttgcttttttcaaactatcatcaatggtgctttctgcatcaaaaacagcaggaaaggcatcataattcaaggtttgaattaaattatcgccactattcacttctgatgaagtgagtttcacacctggtaaaattaaagtaacataatctgagttggtttcgctttctgcatccattcgtaaggcaagtgaaagggatgtgccatttctgaccgcttgccacatagctttatctttcaagtaggtagaaaacgaaccactgactttaattgaaccgataaatacatcaggcgcataggttgcacctaaaacaggctcactgcttgcaccgagatcgatgtcaattttaaaacctgtcacaaaaccgacttccgctttattgagtaacagttttccttttaccccggctaattttcctgattgagcaatcggggtaggatttgtaaagtaagtggcttgtagctcttcacttttttgccctaagaatgaaacagtgacagaggaaataccgttaggctgagcatcaatgctcatcttagaaacacgacaacctgtataaacacggtttacgttaatatcttggaaaatctcttcaatggtgaatgagtccgtggtgtgattggtttcaggcacaatgagaatttttccgtttttctcgctggtaccatttgacgttttcttaataatcggggctttagcctctgcggtaaacgcaccacgcaaaaccgccgcaaagaactgcgaccattgcccagccgatagttcacctttaatgtcgccttcgaccttttcaaaaccgacaatagaggcggaacgttgtaaatcagaacgaatttcttctgattggaacgattcaaaattggcatttaaggatgtttcaatgcgtggaatgattttggctcccgttttagctggttttgtaccaaaaacggattccttgctgataaccagtgttcttttgacttcttgagccatagttactccttattcagctcgtaggctgtgtaatggattgtgataggtaaagccaacttatcatcatttaaaaaaataccgccaatggtgggcggttgagagataacaacttgaacattctcttcaatgatagattgaccgtaaaaatgattgcggattagctccgctctttcttcaatggcatgcgtgccgttgccatttggatagaacaaggtcacctgtaaaaaccctgtttcaacagaaagcggtttatcagaaatgcttgttgtatcgctggttgttacagaaagaaaaaccgcttgataaggcaaactcactttattgtttaccccctcccaagcggtactgaacttacctaattccgttagttgcgtttgtagaatggatcgaatgatttttttcattaccaaagccctaatgttggatttctagctaaatatgcttttagctctttaacggttatccgaaccataccttgaggagcttggatagaataaccattcttcgttttccctgatgggtttttcggaggattaggataaagcccatattccaacgcaggggcataaggcaagttagttgcaatataaatcacatcgccaaatttcgccttgccaatatgttcatttgagccattaaaattcgtgggtaaagctgagacagacacagtccaacttcgccttaacgctcccgtatcaacaggcgatttcgcttgcactttcgcaaaagcatctaacgctactttacgaatgactaagtttttccgttgctcaatctgctcaatttgttgctgaatttgtgcaataaaactactcatttcattgtttccgcccttggcattgataaagcattgcaacgttagctggttttatcggttgaacagcaataatgctccacacctcgccattcacttcaaccgctgagcctacctctgctttttctgtcagataaataaccacatcgccttgctctatcgcaacagcttcccctctagaagttccgccactttgaaatgaagggaaatcataagccagattatcaaaaagacagtaagcactctgtttactgatttcagtttgcattttccccgtagctggatcgtattgcccagatatttgtgttttaatcacacaaggcgaaccaaacttctgaattaactgcttggagatttgctgtaatttaccgtacaaattcaagcctacccccttaacaatgacacattgttagtagatgatgaatttaaaaagcgagaaagcaaagttttgacatactcaaaccgattgctgctaccactgataaccgcttgattttcgtaattgacagaaacaggccccactttcacgcttgccatcttctgctctgtgttctgatttagatctgactgcaaggctaattcgcaaaccgcatatttcacttgtaacggaatttcgctactctcttgactactctcttgacgtggaaattgtctgatttgcgtaggatctgctttctctcccacaaaacgataattgtgatcgagaaaatctgatgcactaactaagcgacgagctttttgttcatcatcaagttcattccacgcttcaaaactagccctcaattgatggtagccatttgcctcttcaagggaaacataactatccgttggtacgttcagggtcattgtcgccccctttcgcttgctttaataatgcaatcagctcatctttcttcgccccttgtggaatttccacattcaaggctttaagtgcggtggttaattctggcacggtcatcttgtctaatggttttttatcagattgttcatcaacccattgaaccttaacccctaaggattgatacgcttgtgcaatcttaggaaaatccccataaatcaccacatcggtcaccttactttctgctttttcaaaatacagcggatttcggtaatgtttatgcggctcaaatcctgtggtttgcgttgtataaattaattgcattgattactccttctcaacataaaaagcggtacgattttggtaattttttgcaaaaacgcaccgcttttatattcacttaacttagttagcttaattcaattaacacgccagccgtatttttattgctggtcgcatatttttgccaacttgctcccgtgccaattgtcgaaaggttagggttcgctcccgcactttctttgtacgaataacctaaaacatcaaggttaaatgttccttccgcacgaataccaatcgctaagttttcttcactgttaatgtcataagctcggaaacccggtaattgcgaattcgtgatagtaattgctccggcttgtaagcctaaaatggtgttagctttggctttatccgttactaacacaggcttgcccattgttgccggtaaaccgccataaataatctggtcttccgattcaaatactttatttgtaattgcatcatcaatcagatcaaaatagacagcagagtccatcacccataaaccaattcgcccaaatttatccccaaacttacgcatccctttggtcaatacttttttgtgatcggttgcaatagacgccgaggctttcatctcagcattcgtcccaattgccgccattgcaccagcagtcaagtatttaaaataaccgtctaataatgcgtccgcatagtcttggccaataaggatagaaaactcctccgtgcttctcgctcggcgtttcattgcctcttccgtaattgcataagggccgtatttaaacggaattttcacgccaaccatttcacccatcgcaatggttttattctcaaccgcgccattactatttacatcacgatgttccaaagaaccaccgattttgtaaaaagattgttttcgaaaatcgccttggatattctcatcttgcaataaaatgcagccgtttgaagcagcattaaatacattaagattatcttgaatacgctctaaatatgcagtttgagccagttcattgtagataatcacatctttgtttaagcctgttgccataatgttttcctttattctttaggtagattaagatatgcctcacgaccgtgctcctgaataaacttgttcatctcttcaggggtcatttggctacgtttaaattgtttgccagcgggagagcctgcaccaccgccaccaccgcttgagccagagccttttagaatagaatctttgttagggtaagcatccactaaagtctctaacgcttcttcaaaatccgctcgttgccctggtttcactcgactgaaaatttcgttgccaaacgcatcttttgccaaaattgcaccgttttcatcaatgctaaaatgcttaccaaagaacgcttgagccacatcaacaggcattgccaatttctctgtgacaaacttagagcgagcaaacgaacctccaattaactcagtatgcaactgcccttgtactttctctgctaacgctttggcatctgccagcttttgctcataacccttaatcacttcttgtttaaccttttccgcttcacctgcatcaatcagttttttagcgtcaaggttttccaccgtttttaaggcttcttttgcttttgccacatcatcaattccgtcaaactttttgagttctgcttccgctttttctttagcctcacggtgttgcttgttttcagcattgagcgaagaaattttttgcattgcttgcggtgcatcaaaagggatttccttcccgtcatcgtggatatacacaggtttgccatctacaaccacaacattgccgttttcatcgagttttaatttcatttggatttccttcctaagtgagtttgtgtttcttccgaaacgtggataataaaaaaccgcttatacattgctgtataagcagtttggttgaaatttaggtataaaaaaacctagcatttaggctaggttagtagaaatagtttagcttgctgatatttctgctgtctggcaatatctttttcagtgacttttgctagacgacttagatccatattatgagttaaatcagcaatcttgacctttcgagcaatatcatttgcttttactcgttttaaataagtctcgtatggctcgtctttacgtttcgttatcgcaccaatagcatttgctataactgagccaaattcagctttaatttgagcaagtgaaatggtcgtatcttccacactatcgtgtaaccaagctaccgctaactcatcatcagttggttgaacaagtccatcagcaacagattgcagatgctcgacataggcttttccagctttatccacttgatttgcatgcaactgtttagctaataatttagctttgtgagaaatcattagtgaaccttaataaaacgaatagcttctttttcagtgatcactttaaatgcatcaaaatcacttactaaaatcttatcagcccaaaaagtgccaaacttttgatcccaatcttctttttctggttcataagtagaaaaagaaagaaaatcatttggtatgcctcgaataagcttttgttgattttcaccaattttggctaaataatattgatacattatttcactccttttaccttctgaatatctttaggtactgttaatttcgaacttaatatttgcattttttcatacaatttttttctctcatcttgaggtgttgcaggatctctaaattgctcataaagattatgcaatactccatttttcaaatcaaaactttgctgtgtatggtattgtaattcaaaaacaacattatccttttttatcagagtagtaacaaaagtattaacacctttgtaaacagcaccatatttccaagtattttttacaacaacagtgaagtacccctgcttttcaagtgccgactgaattttgtcatattgtaacacaaagttattaacatcaagaattgcagtgtaacgaataacatcttttacgctattgattgcctgtttctcagaaataccagcaagaacttctgtttccacttttctttttagcgactccaaagacttcagacgatattctaatccagctgtttttgcaccaacagacgaaataatttccgtgatcttttctgtaatctctggttctacatcaattgccttttgccgcaattcttcaatgctgttcatagtactatagccaacgtctaaatgtgttaagtataaatcctttaacgtcaaaggtctaccgctctgatccaacatatccgcaaaagtaatcacgcctctacgccataagtccgccttgcctttacctaatacttggtcttgttgctcaggcgatttgcttttcaaccaattttcgtagttaatctgctctgatacaggaccatcttgacttgctcttgtgcttgacggcatttcttccgcatcaatcccaagctctttccagctcttggttacaagctgtaaaatactgcgacaacgtgggtgtaaaggcggtcgttgataaggtacatcgtggtctatcggctttttatccaaatcccacattaacccatctcttaattgacatacggttgatgttcgtgtgtctagtgtagaaaggtgtttttctcctgccaaaatatcaaggttttcatctcttaaggcttgatgagctttatccgccactttagccactgcagtaatgactaaggtttcagcgtgtctgcgagacgtattcatcaaatgcttaacatcggtaatcatttgacttgtttgttgaccatccaacaacccttggcgaataattccctcaaacttaaaggcaaaatcattgccttgctttgcccaccaatcttctaaaggcgaacctgcaataatcgttgcggttttattcgcttttcgcttatattcaggcacttgattaaaaaaatcaaagccgacttcatcattgtaaagctgatgaatatgttgggtttccgccgtgaaaaaaccgcttaactcgtcttgcgtgtaagcggtcatttcttgatagacttttgcaacttcttgcttaagctccttaagcagtgtgtctaattgctttttaggtaaagcatccacacctgcggctgctaaacgattgagcaactcacgttgtgttttactcagctgtttcattacctgctgtctaagatgtgcatcataacgaaaatgcagaattttgcgatcagttaatgcgtatgcaatacgactattcaggctttgtttcggcttgtcctgcgaactcaaggtcatattctaccccctcttcatttaagcgagcttgttcatcttcccattccacattatcgctaatcaaaccacgacgttttgcttcattaaagacggtttgttttgaaagtgtgcctgcttgttgcattttaatgaccatatccattgaggcatttggatcgagatcgtcatcaatattaccgctaatttccaccttaccgacatcatcaatacccaaccacaacccaacgtattccaaagctaaatctaacgcatcttcaaatttattcgcatacagtcgcaataaactgatttctttgccctgctcttctttggcttgactgtctgtcattgctaacacggttttatctaagagtttcgccccggcaacacgcatttggctttccagctctttcaaactgtcttgccctgcgttaatcgcattacctgaatgttcgatataagcaatttgagaaccggctggtaaatgcaacgcactaccgccaacttgtagcttattaacttcagtatcggagaaaatccctaataacggcacacgagcggtatttaaaatgttgtcctgatcggattgtgattgccaatgcttaacattcaaataggccaattcaagcaacggcggctcacctaatgcaaacacattgctttctttcgtaataaacggcacaacaggcaccacttcaagcggtcgattttgagcaaggagttgcacatcatcaatcagcgtccactgcccctctgccgctttatacttacgcatacggccgatttcgtacacataaattattttttcaatcttcgaaccaaactcgccatcatctaccgacacttcttccatatagcggaactgcgtgatttgtcgtttccctttgattttatccgttttaaatcccaaaacatttttaggcttaatcaaaataaaataagggcgagcattagccgctttctcatcggcaatggtacgaatattctcagtacgggtgtaatccactaagcaccacgccacgccgtaagttaaacctgcattaaaccaacgagaagaaaatacatcgacattatttccctctaaatccacatcaggcaaaatatcttgctttaatttatcgtgaacgtcatctgtcgtaatcggctcaaaaaaaactctacctgtcatttggtagagcgtttccgataaagcaggataaagcgttgagcggttaagtctgtttttataagcctcttcttcctcaagactgaattgataaaggtattttttccctgcttgtcgcattgtttttgttccgccaagcaaatcatcaatcatcacacctttttcattcaacgccctaatttctggcatcacaatagcaacatcagacataaattatccttagtaaagtttaagtggattttggctaaaatcccctttccgctgaatacgaggattaagcgcataccgcaacgcatcaatatagtggttatgggcatcaactaatgttggcaacacatcgccagacaagcggtcggttttgtagctatacaagcgaaattcattcaatgtttgctgacaacgtgggtgaatgtagattttcttataggatttaatatgcgcaatcccatcttcaacgctacctttccattttggcacgccatcaatacgaggcaagccgtgtcgctttaaatagctgatagactcaggtcttgctgaatctgctcgtatcacatactgctcaatgccagcaatacctttctgcaaaaatgtggctgtatcatcaagctctaacccaactttgccagcctcatattcaatatacaattcatcattaaacacccagcatttaatcgctgcggttgggtcgtgagcaaaaccgaaatccaacccgtgataaggcccctcaaaatcaggtaaaggcttaaactcaagttcctgatattttcctctaaagacttgagcctcactttcttcaagataatccccctcccaaatccaacgataagtcgcatcatctaaacgggctttatcccttaaacgttcttgctctaatacatcaggaaaccacggattatcgctataattcatctcaacaatcgccatactttcgtcttgatgttgtctaaagcgtaaatccgttgccgaacctttcttttcagggttccacgttaaccaaatttccgaaccgctttcacgcaccgtaggcagaagtttccgccacgccatttcgctcacgctttcagcttcgtcaatccacgcaagtaaaatccgtgcttttgatttaatgctgtcaagattgtgtcgtaaacctgtaaaaatataggaaattcgaccgcactttgtgcgtacatatttctcgccaacctcaaagaaatctgccagccacgccgcgctttgaatggcttgcttgatttcctctagtgatgagtcttccaacgagttcataaactcacgaccacacaaaatcacaccgctttcgccttgcattgcccgttgatacgcaacaacagcggtcatcttggcaaaagtgcgtgttttagccgaaccacgaccaccataagcaccacgataacgcacatcctggagaataaacactggaataagtttaggtgggagattaagttgcactttcatctggagccaccaactcaataatagtaggatgaagtgagccgtcagagtttgttacatcgactttatccttaaacataccaagatgtttacctaatagctcaagtgctttatttgctgcgtgaggctcaaaacaaactttctctacatccataggaacaatagaaccatcaaccttgcttagttctgtttctgtgattttctgcttgcctgtactcattgagataatttcaagtaatccctttaaaacatcatcttgagtaacatttactcgcgcagctcgtttgttttgagcttcttgaattgcttcttgaatgtctacatttgacagcaagcgactaccttcacgatttgctgttttttcagcataaccagacctaatcgccgcttgtgttgcgttaagatcaattaagtattcttcaacaaaccgctgttgtttgtctgttagtttgaatttacccacgcctttagacgtggatttaacctcgtctttcttcgtcatcgtggttaatcctttttatttcaaaacattcaataaattagcaatggcattaattagctttggtgaaacaaacgctaaaataggtagtgttactgcaaggcttatttgccataaaccatattccataagtatctccttgatggttacggttaaaactgtcataatctccataaatcgttactcattcggctttaatgggtaatgaaaaaccccgatcatttgcagtgatcggggttttgttatatataaattacattacttgcgtattttctcggaaatttatctaacaaccccaaagccataagcaaattatgtagcatttgatttacataaaataaaagagcgatcatctgaccgctctctaccgtgacacaaacgttaatcagctatttaaacccttgcttagttcgtgcttgccactctctaatgctatcaatctgacccgcacacaagtcacgttctcccatcaccttaacgagatactcgatagcatcaccataggtcgtaccactaaactttgaccgctcgcactgcactaaaaaggcttgcggtggatataaatactcaatctttgtccttgctgtgcaaccgcttaagctcatcgacaacagggcgaggcaaagcagtaacgccacacggctctttctgtaaaatagatttaatctgttcattactctgctccacctgttttcgtaatttatttgcaatgttttgctgatattcaaccgcttgtcgctcttgttgcagttgcattgtcagcttattgtttgcttcttgctgttgctcaatagtttgggcttgcgtctggttctcggctgttaatgcacttatcctctgtgactgaccccacaaccacgcacacaagcccaaaatcaatgccattaagattttattaacccagctaaacataacgccttctctttctcacgacggatttctaaccctcgtaacttcttgccacctgaataaacccacttaggcaactcattacaggcaccaacataatcgcctgatttgattttacgaaagaatgtcgatttactcacggtgccacacccagcattaaatgtcagcgaagtagcaacatcaaacaccgattgcggaatatcaccaccatttgcgtaacggttcacacatttttctgcatgctgaatatcgaccaaccaacgctccgcaatctctttgtccgtgtaaacttttctttcaatcttaccgcttgacgcttccgttgaaccaataccaacagtaagcacatttgcaggacacaaataaggctcacgtttacaaccttctgcatcgccgataatctcaagcccttgctgacttgtacgaaattgaccgtgaaaatctgtatttaataccgcaataatggcactgacagcacaaaccccaccgccaactttacttaatgtttttattcggatcatatcttaatccccttgagagttgttgtttacgtatctgatgcatttcttcgaggtggcgcatctctgctttatgcttttcttcagccctttcttcttggcgtctttttattttcccttctcggcattttgagtacatattaactaacgctgtaacaatccctagagccaaactaatgaacattaaattttgttgatcgcctaaccatgctaaccaacctgtaagcccattccatgcatagctctgcattcctgcatctctcatagcatttttcataccttagccctcgtttcaggcaataaaaaagcccagtccgtaaagactgagcttataaactggcaagagcagatggaatcgaaccaccactaacggttttggagaccgttgtcataccattagaccatactcttaaaacaaaaagccccaacggcataaaccatcagggctataaaatacatgcggtgaacatcacttacacgacgaccatcattactgatatattataggaaacctccaccaaattcaacgactttttacacattaaaagcatatttttgtaatttaactgcatttttatgatttttaatagcaagatcgagaaatttagcaattacccattctgaagatttaatactgttagttactcgtttataccaagcattaaccgagatagacttatctttctcccgctgatacttcgcaatcgcatacaccgataacccatacacatactttgcctcaaggtatttataatcctgcagacaaggatttttaatgcaataaccaattacagaactaatcactaaccccaactcattatcacacatttcccgaataggctcagaaatacggctagggtcggcttgtaacatcaatcttgccaacatattcatacggctttcaaaatccaatccactaaatgcccacgctccccaaaggtttaacaagttctcaatccacgcttgctttggttcttctaacagtttatccgccacatttcaactccttaatcttcgccttatacgttttaataatgtccttacaatcctcaaccgaccacttcacaggagggtgatagctttccaatgcttctactcgctctgccccgattttacgcacaaggttgatgcgatattctgtgatatttccgctcaaatgattgttacaggcactacattgtttatggacgttatcctcgttaaatctcagctctggcattgcttttaccgtgcgataatgccctgcgtgatattgaccttgatgaaaacgctggcacgaaatacaaggctcatctttatctcttaaccgaatgtattcattaaaaacagcttgagcatctctaagccactcagcacgagattttaaacgttctctcgttgccttaatctttgccctttcctctcgatttcgcttttctattgctttctgacgtgatttttcttgggctattttggcaagttttaccccacaatcaggactacaccattttctaaaactatccgcagacttaaactcaccaccacagcatttgcatttacgagctttcacttttggctttatcattaaatgcctccaactcttcctcactccaccgcttaccgcacttcaacccagtacattcaaacggcttaaccttatcaatctctgacttttcagaaaacctacgccagtcttttaaaattgattggcagtttgggcagtaaaatttcatttattcacctaaaatacacacactacacacaaatgatttgcttttaacttaaaggataggtataatacacacactaaaacaacataggagttaggcaatgtggatagcaagaccataatcaaaatgattgaagcagatggttggtacttagttgcaacaagtggaagccaccatcaattcaaacatccaactaaacaagggcgagtaacagtgcctcatcccaaaaaggatttaaaaaaaggaactgaactctcaatacttaaacaagcggggctaaaatagccctgctataactacaaggacaaaatatgttatacccaattgcaattgaaccaggtgacgaaactcacgcttacggcgttatcgtgcctgacattccagggtgcttctctgctggcgataccctcgaagaagcatatcaaaatgtcaaagaagccatcgtatttcaccttgaaggcttagttgaagatggcgaagatattccattaccaacgagtatcgaaaatcaccgtaacaaccctgattttaccgattacggtatgttctttgggattgttgatgttgatattagccatttactaggcaaagccgaacgcatcaacatcaccctccctagctatctcatcaaacgcattgatgattttgttgcggttcacaaagagtataaaaaccgtagcaacttcttagctaaaatcgcagcggataaaatcttaaccgcttaacgcttacacctacgcttaaccactaagcgtaggttatttcccccccaaaaaattccatctgtcattaaaatgcactccattagaaacaccccaagcggtcacatattcgattaaacttgccattcgttttacactcatttgagccgtactctcacgaatattcactaattcgccttccaatcctgtgaccaaacaagagccttctttcgttgcttcagcgtgggcagaaattaaaatgaccttccacgtttcaggcggtagccattcgccgttaaattgcacctgtctggcaatatcgccgcacattgcatggaatttggcattttgctcaaggttacgagtaataggcttcacatcaatcactaacggttttttctcatctatcggcaacgctttcacaaattcaagggcattgtttttgatttgctcagtgcgtagaaagtatttttgcttatgctccatacctaccaacctttgttccatacctaccaacctccttacttcttaacctgctctttcgtaaaatacccacaagacttcgttctgttcatcgcacaatccttgctgatgttggggaatcgccctgtgtaatgaccgttacagcgataaggctcttcaacgtgccacccccagtcgtcattaatacttaaatcttccagctctccgccacatttggggcatttgtaatcactcatacccacctacatcaaaactcacctaaaaccccctaacctgtttcaacaaaccaccccagaaagccctcaccttttcacgatcgactgctttcacttcttgaggtaatgccagtttgggttctggtaaaacctcccctgtttttaaccacttgctcatcttgacgagagattttttaatctcatctttgagttgcttatcactccattcaccagtccgacaacgcacatacaaatcggtaatcaagtaatactctgccgtagaaacaaacttaaacttctggatttcttccataccaaatgccataaacgcttgtaaccgcttgtaaagtttatcctcatcaggcaaacctaacgcttcgtagtccaccgctttgcaccactccacaaactcgcctacgcttggccagaatggatttttagattttttcgctcgcgcaatcccgttttgcttcacggtaactgtctgcatcagggaatgaatttttccacgcaggaaaaatcgcccgaagctgaatgaataattgattaacggctctaatcgcaccgtctggaattgccgttgtctttgctggcacttggtaatttggctcttgcccgacaaggcttttcaagttcattgatgccacgttttgcattaacttccccttagcgtgatagacataccttccgcccagttgccttcgtcatcagggataaacggcttggaagtattacgagcggacggattttgtggattttttgcagaaactccgtcattttgccaatcccaaccagcattgaacccacgccaaccacgctcaatcgaaatcgcaatggcttgttgaataggaattttggctttgtccgcctcacgctgaaaacctttcaacgcagtttcagtgatcggagattttttggctttgcggtgtacgatgaaatcttttgccagttgttcggtaatcccaaacttttccaacaaaatcaaatcttcggattttttctcgcacgcgttaacacccgttagggtgttatttttggtattgttattttgtttagtggtattttgtgtgtgagctgagttcacaggtacttgtgaacttacttcacaggtcgagtgagctgagttcacaggtgaacttacttcacaggtcggaattttgtcgaaattaaccgaaaaaacattcattccacgataccctttagacttagttaaaagccccatttccaccaatttgtcacaagcatcaatgacaccacgattacttaaattacatttttccatcatttgagaaatagaaacggcatctttttgcttattccagcccgttgtttgcctaacaacaagcatataacacttaaattcagccccacttaacacgctcattaattcatcaacaaccgcatttggcacttgaaatgaatttggaataaatttactcatagtcctaactccgaagcataacgttgtgctatccactcaatacctttgccagtaacacgggtttgcgtaaaattatgtccgtgttctgctgtacctgttttcacagtaaacagctcttttgaatgaacggtttgatacggcaatagattgccagattgacgatacaacacacgatcacgtaataaacactcaatcatcatcttttcagggaaatttaaaatcttggcagtttcacgcagggatttactcgtgccgacttctacatagtgatcgacaaaatccgctttcggtttcattatttgattttcgagtaacaaagtttgcttttcttcttcgctttcaactaatgccttaagagcttgaagatagttgctcggtaatttctgttgattttctaactcttgccaacgatcaactaaacgagcagtaaattcaggagagaattgagccacaatcacataagtatcacgtttattaatatgatactcgtaatagacttgcccattttgctcatgggtgtacggactttccgcataccccccaattacccctttattcatcaggtttctaatagataagcacacatcacggtgtctgctttctgtgattcgtgcaatctcccgactactcatcgtcagggttgcattttctctctgattagtagataataaatctgttttcataaacattatttcccattacccacgttccagcgtgggtttttattcatctaacgacttacgagccaaagttttgtaagcagccaattccttctcatcaatcagctcaatctccaactcatcacaaatcaccgcgtaccattccacatattgcaaaaacatacggctaaactgcgattcagacacgccgattttgcgcgctaaatctttatgcgttcgagaggcggattttcggtaaatcaaatccgcaatcgctcttgcatttttacttaattcattgcgtgccattgcacactcctttgggtaaattaggttcgtgaaagtaaatctgcgtagctcaagtcaaaatcttcagctcttacttttccgttagttgctttttctagctttaaagcatgctctaacgaaaccttagaagagccatttagccacttactcacagcgttttgactcactccgcaagcattagcaactttcacttgagaacctaacgttttgatagctaattcaatgttctcattcataaaaacaatcctgttgttaatttttatcttggctaaggtattatattatagtcttggttgttttaacgcaagaattttatagctttatgtttttggtgatttaaaactttgattttaaaatgagataaaactaggagtatttatgaacacactttctgagagattaaaattcgctagaactcaagcaaactacactcaagttaagcttgctgaagaagttggtgtatctcaaaacaccattcagaaaattgaaaaaggcggagaaactaaatacgtcaaccagttggcaaaagctttgaaagttaatccagaatggttgcaattcggtattggtgaaatggctgcaaaaacaagtgatgatgtagatgtcattgacaaggataaagattatagcgacacacacattagtattgatatgtatgacattaaattatcagcaggtaatggaaaacctgtgattgaatgggttcctcgaaaatcagatgaaccacttttatttcgtgaagcttggttcaaagtaaaacgtttatctcctaaaaactgcaaggcaatgtatgttcgtgggcatagcatggctcccgtattagaagattgggatactgttattgttgatatttctgatacagaaattgcggatggtgaggtttatgcggttgtttacaataagcatttctacattaaacaaattattagaacaggcaaaggcattcaacttgtgagttttaatcctgagtacgatcctattgatgtaatggatgatgatctaaacaacttacaaatcatcggtagaaaagtttggcgtggcggttgagcatagaagctacttgtagcagcagttgaattttattgggtaacagaaacgtggtttggtggtttaagtaggtatcttttatactatattaaggaaataataaatgtctcaactaaaaaaacatacatttaatatccgttactatgcaaataaatatgaaaaatataattttcgtgatttagtaaaccattttaaagaagattcaatgccagtagtaactataggtaactacgctcgaagggtatgtatttactctgataattctcaattcgaaaactctatttccggctatttcagcacttatagggacgatattctacataaaggaaataagcgaacagggaaagaatcacttattgatttagatgaagatgaatctattattgagagaaatcattttattctcttttatggcgaaaaagaagaaatcctactatatcaaaatagttctttatttggtaaagttaaacatctaaattcctatttaactcacctgactaaatatctatcattagatactaaatttagtgatatttcaatgttagaaattgggactgaagaatttatcaatggtaaacaacacccaccccttaagcaacttgagtacaagctagcaagacctaaacgcaaaacacctagagaaggtgaagatccttggattcaagagcaatttgatgaaatgacaaatcttggtgtaaatgttcaaaaagttgttttatctaattataccaaaacaggcttgctttcaagcacatgggaaaccattaagattttattaggtcatgataaaacgagagccttaaaaatcaccttattgaatgctgagcaaccaatagacttactgcataatgttctgaaagatcgattttctttaattgctccatcaagaaaagaagtggacattaaccaaatatttactaaaatgcgaggcttaaaacaacagcgtagtaatatactaaaagactatttagatgaacctcacgaagagtaggagataattatgcacataaaacactggaagaaaattgcctttttagccagtgtcataatgcattatagcctatggcactttaatgtattaaaactttttgaagtcaatgagcttagagatttgctaagtgatttatttacatcatcagcaaccttaatcggttttatctttgcgataattgctatattagtaacaattagtgagcattctcttatcaaagtgatgagagagaatggtatgtatgcccaaataatgcaacatttgaaatatttaatcagtggatttagcatttctatgctatttagttatgttgggacattcttatctggtaaatggttaatatattgtttattatttacttcgtttgtttttatgtacagtatgattatgttagttactgatatgtttagaagattaactctaaccttcacaaatctaaaatagtcaaaccgcccaccgtggcggttttcttttatcccctaccccatttatgcataaatttcttgtcaaactcgaactgctcttggaatttaggcataatcagcttttcaacaagaattaacatctgctcttcactgagttttaattctttgtagatagggttttgctctaaaaattcatcaataaattgctgtatggcaatgccaaattcctctttattagtcagttgctttttcataaatccccctttcttagattctcttattgtactctcttaatttggataaatcttgcaccaaaagggcaacattttgcccatttacaattctacaagcggtcacattccatcatttttttgcaaaaacatcttcctgataccaagaaaatgattaaaaaacaagcaatcaaacacatatcgaaaaattttttcccatttaaaaacaaccaattaacaacaaaagctataaataactataagataaaacaactttagctatttacataatgcaaccaaagctatattatacacccatcaaaacgagctacggctcaatgctctttaaaaattcagacaaaaacacctcaagcggtcaataagtgcagttgcttaaactagcggattaaaagccccgctggctgattgaacgtttagtcttatgtgaaaaactgccgtgacggcagattggcaacagaaccattgaggtgacgactaacccactatcgccaagtttgccagtgagtggaacggatagtggggacagaaccacattttttggtctgttttttagttggtgaacaatgaaaaagcaacagacagcaaacgttagctaaaaacgtgacagctcggagagacggcatctagccattcaaaaccgctcttattcccacagccacatatcagcctagttacctgatatgcgttactagagagcggttttgaatggcaacaaacaaaagaggttaaacaaaatgaacacagaaaactactcaaaagcggaaagtataacaagctcaaccgttaattccgtgcaaaaacaccaaattatagaagcggttctaagttccatcaaaattactccgtattatgacggtttggaactaaaggcttgcaaagccatttctgcgatcaacaaatacagtgatgctgaagtaataagtgaaattatcaacaatgaaacgggagaacgatttctaaaatctgattaattttcccacaagtctgaaattttatttatggctctcattgttgcaaaatcgttattcgagcaatcaaaaacacccaacctatcgtctgtatcaataaactgatttaaataatccctgcattgcgttgcagtatgtgtttttgaacgcacataccatacagattcaaacacttttgcataagtaccatagcttttaattgcatcatagagtttttggtagtcacgactttttcgtaaatcataggtaatgatgagattaggcatacttattccttattttgtgtttgtggtatagaaataatacagctcgctcaaaataaaatcaatttcctttgcgtgtttgtggtgaataccaaaggcgagttcccgatctcgtcaaaatcggactgaacaaaagtgtacacggtaagcacttaaaacacccgtaatcataatgatgatccgttagcccactgtaacaggtgggtgtttttcaataaaggaataaaaatgaccttaaaaaaatgtttacttctcctgttgcttatcaaccttaaccctattggcttgtggttgaatagctttgcatttaacaattttttcaatgatcaaccccattatctccaagaagataaaaaagccttgccagaatgcagtagcagcagtcaaatagaataaataaacaagagcataagaaggtaatgctggcaatggacgtgcttctaagccgtatttaaagcttaaaggcaagtacaactaacaaagaataaacgataagcaccaagtcgtaatacgcataataatatggtcgaaatgttcttttaagagagaaaaaagagatgcaatcaacgcttcccacatactgaaatctccttttgttgatgaatataaattgagcacttacattctagcacaactcaaggggatttcagtctgtgggattgacaccgcccaaaatcaaaaaagggcattacgcccctttctgattaaataactcaaccgcttgcacaatcacctgcgtttgtgaaataccgtgttgctcggcaaggcgttcaataagctcaatcgtttcttgatgaagtttaaagcctttgagcttaacaccacgcttagcttcgcttcttgcttgcagttcctgaagagttaaaccagattttgggcgaccacgagagcgtttttcagtttgcatagaaattccttgttgatcttttaagccaaaaggcttatagttggagccgtcagggggacatccgaccttcccccttcgggagttaccttaaactacagtacctgaacaacaggttagtaatactacggtaactaggattagaactctgaaaatcttcatatcctagctccatttagtagcccagtgaaagctgggcttctcattttcagaaccattccgaaaataaatatattttaggttaaactaaataaataatcaagaccttattcaaggttaaactaaaataattgatatttttatgtttgacaaccgccccccttcggattaagataaccgcacaacaattcttctagcggcaatccgcacccgatagcatagcggtttttttatgcctaaaatttgcaaaatccttaaaaccccagatctggggttttcaatggacgggtcgagagagccaaatacaatacctgaaagggaaataagctccgccgtctagaagcggttgttgaagcccgttcaaccctacaaaagttgaacgaatacaaacaaacttctaggggcataaaaatgtcaaatttaactattcttaaaacttcaatcggtcaattagacaacttattcaatctaaaagatctacatcgtgtcagcggaaatgaagctaaacacgagccatatcgtttcgttcgcttagataccacaaaagaattgatcgaagaaatccaaaaagaagatccaacaacgcaaccacttaaaaccctacgaggcacacaaggcggaacatacgcctgcgaagaactcgccctcgcttacgcaatgtggatcagcccaaaattccacttggtcgtattaagagcgtttctcgcaatgcataaaggcgaattgcaaaattctgcacaaatcgcaccgcttacaattacccctgagcaacaacgagctatacaggaagcggtacaacaggctcactatcgaacaggattacactggaaagaaatctactctcggctcaaaagcacttttaacgtagcgaagtatgaccaactaccgcaaacaatgtttgaacacgttatcaacttcttaaacacactcggcaatcaataccgcccgattgaccgcagtaaaaaagacatcaccattgcaggtttagatgcagaacaaattgccaaatacctagtaagagccagagcctttgcaaaagaagtcgaagtatttcatcgtaaactgtacgaagatttaggcatttctcgctatgttaaaaacgatattgcaggaaaagcctacgacatcgcacacgaatttaacgtatggcttgacccttttattgaacaagtcttaccccagcttaatcaacaacgattagcaagattttaaccacaacccaacaccgaccgcacattgcaaaaatcgtgcggcggttccccacacccaaattaagagaaaatgacgatgaaatacgtaaaaatcctactatttttaaccgctttctacctcgtagccgaccacctcgagttatacaacgactgcgacggctacatctgcgaaacccgaaaataacccacttataggagaaaaacaatgaaagaaattaaattaggtatatcaccattgactaatcaaatctatgctgggcatctcgaaaaaaatgggctttattggaaagaaaagcaagatgtaacgttaatggcattatattgtgttgctcaacattgtattgaaggtaatgaacctgttattttgttagaacacaataaaccaaaatatgaaataacagtgagagtaatcaatgactaaaaccgtcagcgtaaaccaccgcacttttcaaacgctcgccatacagtcattacgctactgtatggggcgtagaacctttgccgtgaaagattgcgtagagcttattcgtggacactggcaagatcttactaacacgccaaagacatcatcattcgagatttagatgaggctctacaatcccacgaagacgacctaagagacaatagaggatattgctacttaggcgaccagtgcgactaccaaaaatggaaaaacctaagagaatggatcaacgaataagcctagcgaaagctaggttttttattttggtaaaaagtatgacacacatagaacatttaacaattaaccaagttgccaaagagttaaattgccacccaaacaccgtccgccaacatttagcagattggggattttttaaaatggcaggatctagaatttggagggttaaacgatcagatcttgaccgagtgaaaaaacaagcgaataatgaccgtggggtatctctgtcggtcgaggagaaaagaaaatgtcgatctacagacgaaaagcaaacggtccgtggtgggttgatatcacaaccccaaacggcaagagaattaagagaagcattcgcacgcttgtaaaacgtgaagcacaacagtatcacgacaaactcaagcaagaaatgtgggcagaagataagctcgaaacaaagagaaaatatatcttcgaagatgccttattgcattatgtccgttcagccgaagaattaaaggataaagccacgaaaaagcgacacgcagagtactggctatctaaattcgcaggtcgagaactcagctctttaacagcacaagaaattatcttaaatatccccaaaaagaatgccaatactaaacaggcgttatctcatagtacgcaaaataagtatgttaaatctttactaagggtattaaatattgcccataagctcggtatgctggattctgtgccatatgtggagaaaaagaaagagcctccaattagagtgcgttggatcacgaaacagcaagcaaaacagctcatagataaattgagttccgactggatgaagtctatctgtaaatttgctttgatgacaggagcaagacggacagaaattttaacaatgacttgggataagatagattttgaaaggaaagtagcaatcgtgactaatgatgttgcaaagtcaggtaaggcacgatcgctattattaaaccaagaagccataaaacttcttgaatctatccgccaccgccattctaaatatgtatttgtgggcagaaacggtaatcctttacaggatattaaccgaaaagtatttaatttatctacaaaaaaatgcttattatctgatttccactttcacgatctccgccacacttgggcgagttggcacgttcaagcaggaacaccacttttcacattaaaagaattaggcggctgggaaaccttagaaatggttaaaaagtatgctcatttaaatgcagaacacttattggaacacgcaaacaaggtcgaaatttacggtacatttacggaacattcgcaaaatgagtccagattaagattagttgcatagcttataagtgattgattttaaaagaatataatggcacgccctaaaggattcgaacctttgacccacgccttagaagggcgttgctctatccagctgagctaagggcgcattgcactatgataagatagtagtttgaaaacgatagaatggtcggcgagataggatttgaacctacgacccactggtcccaaaccagttgcgctaccaagctgcgctactcgccgtcttgtcctgaaaagtgcgtgctattataaaaattttattattaaggtcaataagtttttaagtaattgcaattaaatgttcgttctttaaacatcttcaagattaatgcttactaaaaagcaatttttttgagagaataccgaatgtatactgtcaattacatagggaaaattagtcatgtccgcacaaattatttcgggtaataaacttgcacaacaaattaaaactcaaatttttgaacacattgcgtcttacgtgcaacaaggataccgtgctcctggtttagccgtcattctcgttggctcagatcccgcttcacaggtatatgttgggagtaaacgtaaaacgtgtgcggaattaggaatttattctgaatcttatgatttacctgcagacacaacggaaacacaactgctctctttaatcaacaaattaaacaatgatgaaaaaattgatggtattttagttcagctccctcttcccgagcatgttgatacaacaaaaatcattgaagccatctctccagataaagatgtcgatggttttcatccctataatgttgggcgtttatgccaacgtattccaacattaagagcttgtaccccttatggtgtaatgaagctcttagaaacaacaggggagaatctttatggaaaacatgccgttatcgttggagcatccaatattgttgggcgtccaatggcgttggaactattactaggaggctgtactgtcactgtcactcatcgttttacaaagaatctagaaaatcatgtacgccaagccgatttattagtagtcgcagttggaaagcctaatttaattcctggggaatggattaaagaaaatgccatagtgattgatgtgggcattaatcgtattgagggaaaattggtaggagatgttgaatatgaagtggcttcccaaaaggcaaaattcattactccagtaccaggtggtgttggaccaatgaccgttgctatgttaatgcaaaatacgcttctagcttatcaacgacatatcaacccctaattcctcttttcaaactgggaatactggttaaactaaattgatttattaagaatatattcatattgaactcataatagatttgctaaactacagcactctgttgagagtgaaggttagagaggagaaattgaaaggcttagctatcagaattgcatgtgggattgcattattgctgtgggcatgggatatggtatttccttggcaacaagcaatgcaggcagaagaaaatcgttatacgcagatccaacaacgtaaaatactgaaggtgggaatgattaatcaccccatctcttattttgagggagcagaaggaaccgcagggatagaatatgagcttgctaaagcgttttctgaatatttaggtgtcgggttagaagttaaaaactacaataatagcgaacaattatttaatggtttgaaactcaatgaaattgatattgccgctgcaggattgctatatcaattagaaaatgcagataaattccaaattggtccaagttattattctgcctcatggcagattgtgtataaaaaaggaagtcagcgcccttacagcattggtgatttaaaagatgaattactaatccctgcaggttcagctgttattccaattttaacaacattgcaagaacagtacccctcattgaaatggaaagtaacagacaatttcactcaagaggaattattaatacaagtagccgatggcaaaattccttatactgtagccgtgtctattgatgtctcagctgcacaacatattaaacctgatgttgccgttggatttgatttaaccgatgaggagcctgttgtatggtatttacaaaatagcgggtatagtgaactgcaagctgccgtattaagttttatggataatgcgaatgaaacaggcttaatagcaagaattgaggaaaaatatttcaattatttaaatcgctttgactatgtggatagccaaagctatttaaaagctatcgacactgttttgcctaaatatttacatttatttgaaaaataccgaggaatattagaatggcagatgcttgcggccattgcttatcaagagtctcattgggatcctacggcaacatcaccaacaggggtgagaggcataatgatgctcactaaagataccgcagaaaggatgaatgtgacagatcgtattaatcctgaacaaagtattaaagctggctcagaatatctacatttattaatgaatcagctacctcaaagtattgcatcggaagatcgtatttggtttagcttggcggcatataatatgggaatgggacatttgattgatgtgcggcgtttaactaaacaacttggaggaaatccagataattggcttgatgtaaagaaaaatttgcctctacttgctaaaaaacattactatactcaactaaaatacggatatgcccgtggatttgaagcctttcaatatgtagaaaatatccgacgttattacaatagcttgatcaatcatcagagagtgaaagagcaagaaacatcaaactcaaataacacacaggaaatcataaaaatcaattaaaaatagagtaaataaggagtatttatgataaaacgtaaattgaaacagcgtgttaaacgcttaaccatcagtaaatatcgccgaattttgcaagctcatcgtttaaaatcttgcatcgcacaacggcgccgcattggctttgtgatattaggtcagcaacattgaaaatatagaactctagaagagctctacatgaatgactctttactatacataaataggcatctgattacttatgaaatcaaatgcctattatttagcaattctaaatgaactctttatttggaacagcgactcttccaaatataatacccattcacacacaccacaaagatatttaatcctgttacagggaatgaattaatcaaaataccataaatcacgaaacatacagcaccaagtgcattcactaaacgaagttttactacgtcttttaataagaaagaacctgcgactaaaatcattgcaacatagcccaaaatttcaattgcgttcattgtatttgtatcctctattatttgaaaaatctattgcttattttaccgcttattttttctcttgtcggcaaccccttgaaaagcaaaggtttgcgtgaaaaaaatttacaaaaatctattttttactgtttttttatctgaaatagcgtacaatgcaaaacattgttgtactagtaaagtagtatttaaagatggataccttacttcaatttttaacgacttatttcaccagtgtcacttggatcggagctttagagttaggcttgatttatgccctcgttgctctaggggtgctgatttcgtacaaaattctagatttcccagacttaaccgctgatggctcttttcctttaggtggcggtgtttgtgtgctttgcattttgcatcatatcgatccttggatcgccacgttgtgcggaatgttggctggtgctgttgcaggtatgattacagcaagtctgcatattggttttaaaatcgaaaaattgttagccagcattttgatgatgattgcactttattcgatcaatttacgaattatgggatcgcctaatgtttctttgctgggcgaagcgacgatttatgatgcgataactgctgaagatgatgttcaattagcaatggtgcgactgttaatggcaatttttgtggtgattattgctaagttgattttcgatcttttctttgcgacacaaattggtttagctgtgcgtgctacagggacaaatccccgtatggcaaaagctcaaggtattgcaattaataagatgaccttgcttggtatggctatctctaatggattgatcgcattagcaggctcgctttatgtacagagtaacggtggctttgatatttcgattggggtcggtactatcgtgatcggattggctgcagtgattatcggtgaagcgattttctctgcaaaacgtattatttgtctaactgctgcggtaattattggctctattctttatcgctttttcattgcattagccttaaataatgaaacgctaagtggtatcggttttggacctcaagatcttaatttaatcacagcattattggttgtagcggttcttgcgttacctaaattcaagcacaaattcacagcaaaaagaggtcgataatgattgagttgaataatctatttattacgttcaataaaggcactgtgattgaaaatcctgtactacgaggattgagcctgaatgttgccgaaggggaatttgtatcggtaattggcagtaatggggcaggaaaatcgaccttacttaatgccatcagtggcgattatccaatagatagcggtgagatttttattcaaggtaaagaagtcagtaaattgactagctggcaaagagctaaccaagttgcccgtgttttccaagatccaatgacaggaacttgcgaaaccttaaccattgaagaaaatatggctttagcttatcaacgaggtcaaaaacgagggttaggttttgcactgaaccgccaagtcagagagctattcaaagagaaattatccttacttggattaggcttggaaaatcgcttgactgaccaaatgggcagattatcaggggggcaacgccaagcggttagtttattaatggcatcgttgcaaccttcaaatattttactgcttgatgaacatactgcagcacttgacccgaaaacgaccgctttcgtgttagaattaacgaataaaattgttagagagcaaaaactcactacgttaatggtgacgcactcaatgcgacaagccctagattatggggatagaactgtaatgttgcatcaaggtcaggtggcttttgatgtggcgggcgatgcccgcaagaagatggatgtaccagatttattgcgtctatttgagcaaagtcgccacgagaagttgagtgatgatgggttgttgttataaactctttttatatggcgaaggtaaattgtattatccaaagtagtttattgtgttatttgacgatcgccataatgtgaccataaaaggagaaggctctagtgaataaaaatatcaaagtcccttcaacacattcaccatctcaatcgcacctaacgcacattcagagcctttattgcctgcttttgtgcctgcacgttcgatagcttgttcgatattttcagtggttaatacaccaaaaatcactggaacacctgtttgtaaactcactgccccaatgccttttgctgcttcgttacacacataatcataatgcgtagtcgatccacggattactgtacctaagcagatcaccgcatcatacttaccgctttccgccatttttttcgcgaccaacggaatttcaaatgcgcctggtacccaagcggtatcaatatcgctttcgcttgcaccgtgacgaacgagtgtgtcaatcgcaccgcttaacagtttatcgttgataaaatcgttaaatctcgcacacacaatgccgaattttaaccctgttgccactaaattacctgtgataattgccatttttgcttttccttatattgaatgtaaattgatataaaactgtcgtagggacacactgcgtgtgtccgtaaaatgaatgttatttaacaagtttagaaattaaacagatgtctcattttaacttgtttaactttaaggtattccaaatcgtgtttattcggttcaaccataatcggctctcgtgccacgatatttaagccaacttgctgtaacccctcgattttcgctgggttattggttagcaagcggattgtttttacgcctaaactgcgaaacatctgtgcaccgatatggtattcacgttcatcttcaccgaagccaagagctaaatttgcctcgacggtgtccattcctttatcttgcaactcataagcacgcagtttattgattaagccaatgcctcgcccctcttgacgtaaatagagcaacacgcctctaccctcttgctcaatttggctcattgcagcggcaaattgctgaccgcagtcgcaacgttgtgaaccaaaggcatcgccggttaaacattcagagtgaatacggcacagcacctcttctccattgccaatatcccctttcactaaggcaacgtgttctttgcctgtgattttctcgataaaactatgtgcggtaaagtcgccatatttggtaggcattttgaccacagaaatctgctcaattaaacaatcttttgctcggcggtattcttgaagctgggcgattgtgataaacggcatattgtgttttgtggcaaaggcttgtagttcaggcattttcatcattgtgccgtcgtttgccataatttcacaacacagccctgcgtgtttaagccctgctaaacgagtcagatccaccgttgcttctgtgtgtccgttacgcaccaacacgccaccgtcttttgcaagcagggggaacatatgccctggacggcgaaaatcacttggtttggcgttgtcgtccaccactttcagtgcagtaagcgaacgctcaaaagccgaaatgcccgtgcctgtatcaatgtgatcgatagcaacggtaaaggcagtttcgtggttatcggtgttgtaagaaaccatctgcggtaagtcgagctttttggctatcgccgttgaaattggcatacaaatcaagcccttaccataagttgccataaagttgatattttcaggagtggcaaattccgccgcacagataaaatccccttcgttttctctgtcttcgtcatcgctgacgataataattttgccttggcgtaatgcgtctaaggcttgttctacgcttgaaaattgaaacatttgctttccttttcgtttaatactgtagggacacactgagtgtgtccgttattcattcattttgtggacacacacagtgtgtccctacttaaaatccagcccgctttaaaaattcttctgtaatattgctctgtggctcactctgtttcggcgacagcaatttttccacatattttccaatcacatcattctctaaattcacgatactgccgaccttttttgtgcctaaattcgtttcgcttaaggtatgtggaataatcgacactcggaagctattttcatcacaatcgaccacagtcagacttatcccatcaatcgtaatcgagcctttttcaatgatgtaacgcatcagctttgctgttgttttgatctgacaccagactgaattattcgcaggggtaatgctgacaatttcacctgtgccatcaatatgccccgacacaatatgtccaccgaaacgcccgtttgccgacattgcacgttcaagattaacggggctgttcggctgtaattcgcctaatgatgtacgggcgagggtttccgacattacatctgcagaaaaatggtttgtgccaaattcggttacggttaaacagacaccattgaccgcaatgctgtcacctaaatgcatatccgcaaaaattttgcttcccgtaatagttaaaacggcaaattctccttgtttgtggattttggcaactttgccgacttcttcaataatgcctgtgaacataatacatcctttgtagggacacactgcgtgtgtccgttattcattcattttgcggacacacgcagtgtgtccctaccttaaaaattggctgttacggacacacacagtgtgtccctacttcataatcaatcagcagatcttctccaatttggctgatctttgcatttttcaattgcaccgcatttgccaacacgccgatcccttcaccaccgattggcgttttggcggttacgccaccgactaatttcggggcgatatagcaatgcacacggtttacaatgccagcgtttaacgcactaaaatttaaacttgaaccgccttccaacaataaactgtcaatcccttgttcaccaagtttttgcaaaagatcggctaaatcgacccgcttgtcttttgctttacaaatcaacacgtccaccccaagcggttggaattgggcgattttttgcaagtcatctgaaaccgtcgcaataatcgtgcgataggttttggcagtttggactaattgacaatctaatggcgtacgcaactggctatcgcatacaatccgcactggctgtttgggattcggcatacggctattgagcatcgggttatccgccagcaccgtatcaaccccaaccataatagcactgtattgatgtcgggtacattgcacattagctctggcttgttcccctgtgatccatttggactcgcctgttgcagtggcaattttaccgtctgcggtcatcgcatatttcatcaacacataagggcgtttggtttgaatatagtgaaaaaaaataggatttaacgcatcacattcggctttcatcacattttcaatcacctcaatcccagcttgacgaagttgtgccacgcctttgcctgccacaaggggattgggatcacttgagccgacaacaacagttttaatccctcgttcaatcaacaaatttgaacaaggcggtgtccgcccgtgatgacagcaaggctcaagggtgacgtaagccgttgctccgcttacatcttcctgacaatgtaaaatcgcattgcgttcagcgtgccattcgccgtagagttggtgataaccttccgcaacaatgttgccgtccttgacaatcacacaaccaaccaacggattaggatttgtccagccacgaccaagttcagccagttcaatggcacgagtcataaaaatagagtgtgtcatttggttttttgaattacaaattgaagggcaaggaagaaaggcaacaccctcccgtttaagggagtgagaccgctttgagcaaagtaacagctttacgaaaagcagagagaggcgtgtttattgtaagccctctccttccgcaaattctaccgaatttgctccaccctctcccgcttgcgggagaaggaaaaataaaagccttgaaatctcacgatctcaaggcgttaaaagcataagaaaagcactcgaaaatgttcaagtgtagatattctagctcttcttccatccagactattactgtcggtactggaatttcaccggttcctgctttggctttcgccgccgctcgcagactttactgccgatcgggaatttcaccctgccctgaagattaaaaaattttcgcgaattttgcggaaatttataggtaaagtcaattacaaatttttaacaaaactcacatttatattatttgctgctttcgagttggtcaaggaagtcttgatttacttctatttttgcacgttcacgtaaatctttgagtaaatcattacgtaacacaactcgctctgcttggttaaactgtgcttgtaaaggtttaaactcgtcagccgaaccatcgctcactttatctaaagcgataataaccacgtcaccattcgcattacgagcggtctgatatgttggtttttctgcgggttttgttattgaaaagactgcttgtgctaaagttggttcagtaatttgagcttgtgcaaagacaagttcttcaactgcaccaaatgcgacttctactttttcgcctttatttaatgctgtaatttgtgtagccgctttctcttctaaggctttaactgctttttgttgttttactgcctgttcaaccgctgattttgcttcgtcaaaagtttgtacattttcagcttgatattgacttacgcgaacaaacatggttttagtatttgttgcatcgctcacatcaatagcttctgaattttgcccattttgacgaacttcactatcaaataaaacacgtaagactttctcattattgagttcagcaggtacagtttcacgtgtgaaagcctctgttttatgaactagaacattcgctacttttgcagcagcttcaagtgagccactattttcaaacgctacgtttgccatttcacgggttatgttcgaatattccgttaaaagtaattcattatgaattgtatcggtaatttgatcttttactttttctaatggcactacagtttccgtattacgctctaacacttttataacatgaaaagcattatctactttgattggttggcttgttttgccgatattcaatgcatttgccgcactctcaaaggctttcgggaatacgcccgctttcgcccaacctaaatccccgccttgagcagcagataatttatcttgcgattttgattttgctaattgtgcaaaatcttctcctttagcgagcgcttgtacgatttcatttgcttccgcttcagttgctacttgaatatgtgcgattttcgcttcgccttttgtcgtatatttagctttgtttgtttgataataagtgtcaatttgttcgttagtgacttgaattttattagacaaatcctttggttcaacagaaatatattctactgtcaatttttctggattaacaaaattcgctttatttgcttcataataggcttgcatatcctctacagaagcagtttgatttgctgcttcttttgctattgaataggtcgctaaacgtacttggcgtttttgtaaaagtaatttcgctaatagttcttgttgtgctggaactgtaaaactactatttacaatagcctcttgaatttgcgcaaataacataccttcgtaaacaattgcagcataaccatctgccgttaaaccattatttcgtaatgcttgctgatacaaattattattaaatttaccatcttgttggaaagctgggctgtttacaatttctgatttaatttgatcggcactaatgtcaattttaaggctcttagcatattgacgaagaagttcatcatcaactaaaccatttaaaatactatcgtggaactgtttgacataaacaggattatccattaaatcccaaaaacgctcgcctaattgagcatttaggatattctgttgctgattttttgctcgaccaaatgcttgttgagaaatttcttctccattgactttggcgacggaattgtctgtagccatcaacccgccaccaataccgcctaatacaaacgaaagagaaattaaggctaaaacaactttaaataagggaccactggttctctcatgcattttttcgatcattttattattcctaaattataaaaaattgccttcaattatactgtaaagccataaattctcaaacctttccttgctatgcatggttctttatacaactttagactttgcaatttaagtaaaaatttggtttaatttgccagttttctactcttcaaattaacttatttttataaggataccacatgggtatttatgcttatatctgctttctgtccgctctctccattttattaggctttgtgactcataaaatcagcgacaaaattcagtctactattgctattactgctgcggcaatgattggctccctcttactgcttttactaggaactttcggttggtttaaccttggtgcagtagcaacagaagttatggagcagatcgacttcaagagcttcttacttaacgggattttagggttcctactctttgcaggctcactagggattaagctccctgtgcttaaagatcaaaaatgggaaattaccatttttgcgttattttcaaccttagcttcaaccttgattatcggtttcttcgtctatggcgtagccaacttaattgggctacaaattggcttgatttactgtatcgtttttggtgcattaatctctcctactgacccaattgcggtacttgcaattattaaaaatttacgcgcaccgaaacgcttatctatgcaagtagagggtgaatcgcttttcaatgacggcgttggtttggtcatctttgtcactatttttgcagtcgcatttggtggccaagaagcaagtttcggcggaattatgagtttattcctacacgaagcgataggggggatcttatttggcttcgttttaggctttcttgcacatattttaatttcatcgactgatgacggtagcttagaaattttattaactctaaccattccaactgcaggctttatgtttgcaaacaatgtgttgcacgtttcaggtgcgctggctatggttgtggcaggtattatgattggtaactggactcgccgttcaggtttttctgaacagagtcaacgttatcttgatcacttttgggaaatgattgaccatttcttaaactcgctacttttcttccttatcggttttgcgatcttacttgtcgattttaatatctacggtattatgatgatgattttagcaattccaatttgcttagcatctcgctatatcagcttatggttaccgtataaagtgctacaacaattccgtacttacaatccatataccttaaaaatcatgagctggggcgggttacgtggtggtttggcattagcaatggcgctgtctattcctgctaaaactgcttatgcaaatggtattgatgttaaagatctaattctggtgatgacatattctgttgtgatgttctctattttggtacaaggtacaactattgagccaatgattcgtaaatcaaaacaagttgatccgaatcgagaagagtatctacaaccacaaagtcaatcggatgccaaacattagtttaagctattctgagagaaaagcattgctcttgacagcttttctctttaaaatacgcaacttcgtgtcgtagctgaattagagatcggctattgatgaatattaacttaactactttttaggagtaaaaaatgtctctaagcgtagaagcaaaagcaaaaatcgttgctgaatttggtcgtgatgcaaaagatactggttcttcagaagttcagatcgctcttttaacagcacaaattaaccacttacaagcacactttgctgagcacaaaaaagatcaccacggtcgtcgtggcttattacgtatggtttcacgtcgtcgtaaattattagactacttaaaacgtactgatcttgctaaatactcagaaactatcgcacgtttaggtttacgtcgctaatgttttgaaaaattcttgtttgatgaaaattaagcaaggaaggtttgtataaatctaaattattaatcaagggctgaaaacaatattatattgatttcagcccttttagtttcttattcttacgatatgtcagagattaatttctcctatatcgtttttgtgacgacttagcaatttatgctaatcctgacgagttaatactttaccttgatattcaccggttaaggcttctaggaatgaagtaatatcgttcaactcttgatcggttaaggttttaccactttgatagtgagccattactcgaactgcttcttttaagtccttaacgctaccgtcgtgcatataaggggcagttaaagccacattacgcaaggttggtactttgaagcggtgcatatcggcaggatctttggtttgtgagaaacgaccgtgatcgtcagcagtgatcggtgtgccacgcgctttgaaataatcatcatacaagcccatatattcaaaggattgtccacccattgccgtacctgtatggcaagtgtcacatttcgccgatttaaatgcttcataaccacgtttttgtgcatcattcaaggcattttggtcgccttttaagaatttatcgaaagcactatttggtgtgatcaaggttttctcaaattctgcaatagcatcggttaaagtgtctgcggttaattcaggataagccgctaagaactcttgcataaaagcgtgatcttgtttgaatttcgccagaatttcatcaaagctatgcgaacccatttcaacaggattaagcggtggaccttttgcttgatcggctaaatctttggcacgaccgtcccagaattgtaagtggttaaaggctgcgttatataccgttggggcattgataccgcctttttgtccatgaatacctgttgatgtggtcaatccgtccacaccgcctttatctaactggtggcagttactacaagccactgtgccatcgcctgataaacgcccatcgtggtagatttgatcccctaaggcaactttgcgtggatctgtggttaatgcatcaggaataggttgaactaagcgagttggatcaacaccagcggtatttttcggcacaaaatgttccgcacgctgttgatggatccagtcaagcaccgtttgcttttcttgctcatcaggacgagaaccccagtgaatatgaataaagctcgcaattggcattgtgtcgttgcgtaacactgtttctaatttagccagatccgcttcagataatttagtcggatctttcattccttctaacattttatccaaacggaaaaagcggttgcctgttgcaacatctttctcaaccatcgagccaataacaggaagattagcatagaaaggtttatctacatttggtgagtggcaatactgacagccattttcaaaaaagactttcgccacttcttgttgtttgccactaaaattagtttgtgcaagtagttttgctgcttggtcttggtcaaaggtatgcacatacccaaccacccctaaaaatccagcaacgcctaaggcaatcgctgataacagtagttttttcattggtaacactccataaagtaaaaagcggatacattatccctataaaaaactacggttattttgatctaattcaatagatttaatttataaatgctatttgaataatcgttaaaatctttctttcatctctaaatattttttagacgctaaatttaatgtttatcaattaaatcttgattgcattttgtttctttttgcacaattaagttagtttttaacctatcttaatttacggaataatttaaatgaaaaagacaatactctgcttaacatgggctttacagtctgttgctctattaatcacgaaggcagtacaaaattatacgagcaaacattaacttcattgaaagcaaaattattgctaacaaaacagcaggtattatgcacagattttattgaaatgaggtatttgtgcacttgattcataataccggataatatgctgcgactataggatgccccaaaaaggtttcacttttcatcttattaagaatgaaattaactacctattagtaaataaaaatagttcttattgacataaaaatttaaacattttaaactcacactgttttgtaaacgctcgctatttatagtgagtttatctctttcttaatgaggacatttttatgaaaaaatctctttctgtgcttgcacttgcattatcttctgttgtttcaacttctgcgttagctgcaaacgaagtcaatgtttactcttaccgtcagccgtacttaattgagccgatgttaaaagactttgaaaaacaaacaggtatcaaagtaaacgtgatctttgcagacaaaggtttagttgaacgtgtacaaaaagaaggcgaattaagccccgcggacgtgcttttaacggtagatattagccgtgtaatgcaaattgtgaaatctggtttggctcaaaaagtggactcaaaaactttagagaaaaacattcctgcacagttccgtgattcaaatggcgaatggttcggtttaaccaaacgtgctcgtgtaatctatacttctaaagaccgtgttggcaaattacctgctggctttgattacttagacttagctaaacctgaatataaaggtaaagtgtgtgttcgttcaggcaaaaatgcttacaacgtttctctctttgctgcaatgatcgaacactacggtgaagaaaaaacgaaagcattcttagaggatttaaaagcaaatcttgcacaaaaaccacaaggtggcgaccgtgaccaagttaaagcgatcaaagaaggcatctgtgattatgcgttaggtaacagctactactacggtaaaatgttagatgatgagaaacaaagatcttgggctgagtctgcgatcattaacttccctaacggtcaatacggtacacacgttaatatcagtggtgttgcgctagcgaaacattcaccaaataaagcaaatgcaattaaattaattgagtatctcagcggcaaccaagctcaaggtttatatgctaaacttaaccacgagtacccagtaaaagctgatgttgcaccttctgatcttgtaaaaggttggggtacttactcaaccgatgcattaaaattagaagacattgcgaaaaactatgaaaaagccttgaaattagttgatgaagttaaatttgatgatttcggtgcgaaataattaatgctgaaatgcccgtggggacacacgcagtgtgtccgctaattacgggttttatgtaaaatttaaacgaacacacgcagtgtgtctgctaattatagattttatgtaaaatttaaacggacacacgcagtgtgtccctacaatctccccccttccttacaaaaagggggaattttgttttttaatggaatgagattttgatcgatttatgataaaccgatacctgacttggcaactttccgctcttgcaactacgctgttaatccttcttccgttgcttgccattggctatcacgcttttgaaggtgaaatggaaaatctcgttcatctttgggatacaatgctaggtacttatctgcttaactcaagcttgttagtcttaggcactgtagtccttgcacttttttttgcattaccgtccgcttggattgttgcaaattatcaattctgtgggcaaaaaacgcttcaatggttgctttgcttgccgttagcaatgcctgcttatttaatcgcttatctttataccgatttgctcgactattctggggcatttcaggaaatgttgcgtggtattttcggttggcaaacaccgcacgattattggtttccgaaaatccgcaccctttacggtgcttgctttgtacttgcccttgtactctacccttatattttcttactggttcgagtggcattattagaacaatccgaaaacctcactcacagtgccagaatgttaggttcatcgccggcggatattttccgtaaaattactttccctttaattcgccctgcaattgctgtcggtatggcgttagtcgcaatggaaaccttaggcgatttcggcaccgtgtcctattttgctgttccaactttgactacggcaatctacgactcgtggctcggctttcaagatctcggcactgcaagccgtatttccatttttatgttgctgatgatttttctgtttatcagccttgagcaatatagccgtcgtaaacaaaaaagctatcagcgtggctatgaaaagaaaacctcgttcaaacagctcacaggttggaaactgtggcttgcacaaggttggtgctggggcttgttggcgttggcgttctttattccattcggtcgattaatctactggtctttccactattttgaacagtcgtggaatttagattttgtgcaatttgccttaaatagcttaaaagtctctattattgcttcgattattactgttgcccttgctctgttactgcattttgctcatcgtctgtcggtcaatcgcagattttgggcgaaatcgacccgcttgtcgttgcaattttcctcattgggctatgccattccaggaactgtactggcaatcggcttgttgtcgccattgacctttgccgatcatcaactacacgccctgctgaaatctttagatctttcccctgtcggcttgattttttctggttcactgtttgccttagtccttgcttatgtaatccgcttttccgcaatggcaatcggcagtcttgaaacctctctcggcaaaatttcgccgtcgttagatatggcaagtcaaacgatgggaaaaacaggcttatcaatgtttagaagtgtacatatccctttgattaccaaaggaattattaccgcaggcttgatggtctttattgaaagtatgaaagagttaaatgcgtcactgttattgcgaccgttcaactttgataccttagcgacccacgttttcacctttacctcagatgaacaattagagcgtgccgccttgcctgccatcgtgttagtgttggttggattaattcctgttatttggctgacccgttcgttaatctctcaatcgcaaaaagaacgttaatatgaaattacttgatattcaaaatttgagctgtcaatttgacgacaatgtggtactaaaatccctctatcttgccgtaggcgaaaatgagatcgtctgtctattaggggcaagtggttgtggcaaaacgacgctactcaaagcgattgcaggtttacttccgattagtgaaggtaaaatctttcttgcaggggaagatttgcagaaaaaaccgattgaacagcgtcaaatcgggctgattttccaagattacgccctatttccgcatttaacggtagcacaaaatattcaattcggcttatgcaaaatgtgtaaatccgaccaacattgttgcacccaacagatgttgtcagtggtgaaactacaaggctttgaaggacgtttcccacacgaactctctggcggacagcaacagcgtgtcgccattgcccgtgctttagcttgtgaacctgaattattactgctcgatgaacctttttccaacatcgacagccaaacccgttatgcgatgatccaagagattaaacagatcttaaaaagccaaaaagtccctgcgattttcgttacccatagcaaagaagaagcctttgcctttgcggataaaattgcagtgatggatcaaggtaagatcgtacaattcagtacgccaaccgagctctaccacgccccagtgaatgccttcgttgctgactttttaggtgctacaaactacctgccgtgcaaagtgttagaaaatcacttccttgaaagcccgattggtacttatcaattccctgaaatcgagtatccgcttggtgattatcattggttgctccgccctgagcagattaccctgaaagccgatgacaacgggcaaggtgtggtggttgaaaaactgttcttagggcaattctaccgttatcaaattgcaataaacggcacaaatgtcaccgcttaccaaacggcggatttgccactggaagcaaaagtatcggtaagtttccagatgagagagttggtgttgtttgttataaagaaaaactaagattaaaaatttagaatcttttaaaatattattgtgatgatcaatatcaaatagccataaatggcgctatttctcacgtaacatctgctccgccatttttatactttgaatgatctctttacgatctaaggcttcgttctggttgtctaatactttttcccagtaatgaattgcctgtttgaaatcgttatgtaaaaaagcatcggaggcaagcagaagtaggctagcactctctttgtcatcaatttgtaacgctcgttcaagccaagcctttgcttgtggggaaagtcgttgtttatttaaatagtaatcggctgttgtcattgcacctaaaatactcgccttttcgcctagcacggtctgagcattgtgaaaacaggttaaggctgcttcaaaatcgttattgagcgaataagcctgccctagttcaaaccagagtttgccatcattggcattttggcgaagctgatgttgaaggttggtaatatagtgatcattacgctgttcgctactttcttctgcacgttgttgttgaaattgagcaaaagcctgctccccttgaatagcaaggctataacgccctgtctgccaataatagataacgctagagataagggcaatcaacaaaacagtcactacaagcgggcgtttaagtggatttttttgccattgcgatacaacttcattttgttgttcaaatgcttggcgacctgccaattcggctaaatattcagtacgctctttctctgcaaaagtatccgcaaatcgttccgcttgttgataataagtccgattaagctcgttcctaatcattttgctttctctgtgttcgccaaaaaattaggctaaagagtagaataagtaagccaacaggcattccccataatacccacgtttgaggattaaagggtggctgataatggacgaagtctccaaagcgctctgtcattatttgaatgatttcttggtcgctttttccttgattgaccatttcatagacttctatgcgtaatttgtaggcttgagaagcgttggactctaccagattttggttttgacactgtaaacaacgcaatgattttgctaggttaatcgcacgaatacgttcgctatcagaatgaaattgaaaggtatctaccatttctgcctgagctacgagggcgataaaactgaacagtaaaaataagatccgtttcatttatcctgttccttcaatgcttgcaaacgaggcataaaatcttgagcaaaattagggttgtagcctttttgttggtaacgaacaatgccatttttatcaatgagataacttgagggggcagaagaaattctgagggtttccgttaaaaaacctttatcccaatcatcaatcactagctcaaatggatttccccactgagcaagggcttgccgtgcattttcggggcgatctgcgtaggtcagcccaacaatttttaccccttgttgtttcatctcaagtaaaatcggaaactctttaatacaccaagtacaccaactcgcccaaacgtttaaaataaaaggctcatttggtaaacttgctttactgataaccgcttgattatccagtaaatgttttaagctaaattcaggcaacggcttaccttgccaatcttcgcttaacgacacattgtctttttcttttaattgcattactaaaaaaagtacaaccgcaaataagataacaagcggtaaaaacagcaatccttttttcatttttttctccgataaccaaccaatgccaataggctcgccaagaccattattgcaccgcctagccataaaatacgaacataaggtttgtagtgcagacgaaatgcgtactctttattaccaaacttatcgcccatcacaatataaatatcatctaaaccataatgggctagccccacttctgccattgtcattgtacggacatcatagtaacggcgttcgggcaacaaggttgccaatttttgatgatgttgatcataaagatgaaactctgctacttcggcagtgtagtttgccccaatttcattgtggtgtttgacatattcaaagtgtagccctgctaattcagcagactgcgttggttttagtctcacgccaacttcatcagcataatagctattcatcattgccccaatcacacttatcgcaaaaccaatatgagccagtcgcattgcaagcggtcggatttgccacataaatcgctgataaggtagatgagttagtacaacccaaatcgcgagtgagataaaaagagtaggttgccattgcaattgatgcacatagacttgtggcaaaacttgataactgaagcctaaactaagtagcaccgcaacgggtaataatgccagttgccataagatttgacgttgtggaatatgcttccaacgtagcactattgcaaatcccattagacataacaaaatcaatgctaaaggggcaaaaatcgtgttgaaataaggcgcaccaactgaaatggatccccagcccatcgcactgaaaatcatcggataaaatgtgccaagaataaccaccagcgtggctaatgcaaataagccattaaccaataataatgccgtttcttttgaaaacagatgaaaacgaacattgccttgccataaattcactcgtaaagcgaatagagtcaatgcaacaaagctcaagctaaagaacaaaataagcagagccattcctcgctctgcgtccactgcaaatgcgtgaacagaagtaagaaccccagaacgaacaataaatgtgcctaacagacttaacgcaaaggcaaagatggctaataaaattgtccaataactaaaaatgcctcgctgttcgctaacgactaaactatgtaacagagcagtaccaagtaaccacggcattaaagaggcattttcaacaggatcccaaaaccaccagcccccccagccaagttcataataagcccaccaagcacctaacattatgcctgcggttagaaatccccaagctaccattgtccaagggcggatccaacgagcaatagcataatcaaacacgccaccaagcaacattgccattgccattgcaaatgtgacagcaaagcctacatagcctaaataaagcagtggtgggtgaaaaattaatccgacatcttgcaacataggattaagatctcgcccctctggggaagggggaaaactacgctcaaatggattagagaccaagagaataaacaaagcaaagcctaaaataattaaggcgagagaggctagggtgcggtaagtaaacaagcggtcgattttgcctgaaaaaatgcaaaatatgcctgtccataatgccaatgccgttagccaaaacagcattgacccttcgtgtcctccccaagtggctgcaaatttgaagaatgaaggtagttgactattagaatgagcagcgacataggcaacgctgaaatcatcatagataaaagcgtaggctaaacagccaaaacatgctaaggctaataaggcttgaattaaactaaataggcgatttccactcaaccaaaagggttgatggcgaatttctccccataaggaacataaaacctgtaaccctgaaataccagctaataagactaaacagaaataacccagttcgggaagcataatctatccataaaatgtaaaaaatcgagctattttaaccggttgctataaataaacaaagcgaattacgaggattcgctttgttttactcatatcttactataagagctgatatcactattttttacgcttgaataggataacaagagtaactaataccgctgctgttactgcaaagctgaggaatgcagaggtagtaaaaccaatcactaaataacccactgctgaagccaccgcaacgacaagcgtataaggtaactgcgaagtaacgtgatccatatggttacactgtgcacctgttgaagacaaaatggtggtgtccgaaatcggtgaacagtggtcaccacatactgcacctgccattaccgcagataagcaaggtaataataatgcgggttctgcgttggcagccatagctgcagcaattggtaacataataccgaatgttccccaacttgtacctgttgagaatgccattgctgctcctaatgtaaagaggattgcaggtaaaaatgcagggttaatgttgccagcaacaagggttgataaatacttacctgtttgcatatcgcttacgatgccgttaattgtccaagcaaagaataaaatggtgattgcacccatcatagattttgcaccgataccgtacgacttccagtaatcactcattgttactttacgtcctattgcaatcattaaagtcgctacagctaatgcactcaaacttcctacaaccaatgaaatacctacagtagtattttcaaatgcgcctaatacatcaaatggtttgccactttctgctagagcttggtcacccgtgtacatcatcattgcaagggttgccaaaattaaggtgatgattggtaaaattaagttcatcacactaccacttgcttcgacaatttgttgctcttcaacatctgcagcttgctcagcttgttgttcaaaacgagccattgagcctaagttgattgagaaataagcagctacaaagactaaaatcattgagaaaatagcgtagaagttcatcgcactcattgccataaatgcccccaatggagtgtagtttgtaatgccgtaagtggttaatagacctgcaattaaagtgatgatgtaagcaccccagcttgaaattggcattaacacacacattggcgctgctgttgagtcaagaatataagctaatttggcacgagaaactttgaatttgtctgttactggacgtgcaattgcacctacagtaaggctgtggaaataatcgtcgataaaggtaacgaacactaacgccgccgccattaattttgcaccacgttttccttgaatacgtttttgggcccaatttacaaaggtttggttactgcctgaaatgcttaataaggcggtgagtacccctaataaaagtaagaaaagaatgatgtgtacgttatttgaatttaatccttcttcgccataaattaacgaagtgatatttttcttcaaatgtaaaaaggcatcaatcgggttgccactggtaagcattaacgcaccgacaataatcccgatacttaatgagagtaatactcgacgagtaataatggcaagtaccaatgctaataatgcaggcactacagaccacaatgaacttgaataatcaactagattcataaaacctctaagattgtttttaataaaataacacgtcaaacaaagaaagagatctactggaataaacttacttttgatgaagcaaggtgtttagggaagggaacaaaagaaaaacagaataaacccagcctaacagtagcactccatagcctccgctatgacagtatcgttcctttcgataacgataccaaccaattaagatgacgcttaattgatttcggcgaatacgcctttcctctttcttcatcgttttccactctgaaagaatacttatcgcattcgcacctctacaatttgtaggacactaacagcttacctgaagaaacggcggttgccaataggggaaagatggattttgataaattaatatgtcagatttattctagtttgctttaagttattatcaaaatataataagaattttattttgtgtatttacctgaaataattattacgataatataaaaaagtctaaattgatatgaactagttacatttaggagaaaacaatgactgatttattaaaaacgctttcaaatattcgtagcttgcgtgtaattgctcgtgaagcttcaattgaacaattggaacttatcgcagagaaaattgcacttgttattgaagaaaaacgtgaagaaattaaagttcaacaagaagaaaaagcaaaacgtctagaaagcctaaataaatacaaagagttacttgctcaagatggtatttcagcagaagaacttgcgttattattagcaggtacaaccaaagtagaacgtaaaaaacgtgatcctcgtccagcaaaatataaattcattgatgcaaacggtaatgaaaaaacttggacaggtcaaggcagaacgcctcgtgaaattcaacaagcattagaagcgggtaaatcattagcagattttgcaatctaatttgatatgaatacagagaagcccacaagatgtgggttttcttttttatgattgatatgaattagctatttttctaataaatagagaaaacaaaatgattgaaaataaaattttattaacggaatgtcctgatgatacggggcttgtcgctaaaatcacgaatatttgttataaacatcaattaaacattattaaaaatagtgagtttgttgaaagtgatactcgccacttttttatgcgtactgaattacaaggtattttcaacgatcagaccctattagccgatttagaatttaccttgccaaaaggatctatttataaacttgttccgcaacaacgtaaacgtattgtaattttagtcactaaagaagcacactgtttaggcgatattttaatgaagacctattatggtggtttgaatgttgaaattgcggctgtgattggtaatcacgatacattaagaagtttagcagaacgttttgatgtgccgttccatttagtaagccacgagggtttaactcgtgtagaacacgataaactactagcggataaaattgatgagtatgccccagattatattgtgttagcaaaatatatgcgcgtattaaatcctgagtttgtggcgaaatacccaaatcgtgtgattaacattcaccattcatttttacctgcctttatcggtgcgaagccttatcaacaagcctatcagcgtggtgttaaaattattggagcaaccgcacactttatcaataatgagttagacgaaggtccgattattatgcaaaatgtgattaatgtggatcatacttatacagcagatgcaatgatgcgtgcagggcgagatgtagaaaaaacggtattgagccgagcattagaattggtgcttgctgatcgtgtttttgtttatcaaaataaaactatcgtgttataatcttcctctcagccttcggcagctccctcgtaagtagggggagcataagagggataacctatataaaatcatttcataaaatgaaacttgtcgatattttcactgatggttcttgcttgggaaatccaggtaaggggggcattggtattttattgcgttatcaaggcaaagaaaaacggataagtcagggttactacttgacgacaaataatcgtatggaacttcttgccgtgatcactgctctaaatgccttgaaagaaccttgtagtgtacatttgcatagcgatagccaatatatgcaaaatggcattcaaaaatggatttttaattggaagaaaaacaactggaaaaccagtaataatacgcccgttaaaaatcaggatttgtggatagctctagataaagccataacacgccatcaggttgaatggcagtgggtcaaaggccattctgggcataaagagaatgagatttgcgatcaattagcaaaggaaggggcaaataatcccgctttagaagatgtaggttatcaacctagtcaaagctagattatgttctgatttcgtgaagtagatcacaaatgtaaatactcgtcttgtcaatatattgacatcgccttgattagtgttatgatgttttcaattcatttttacctttcattttgattaattcacttcaaaatgaaaggtaaatacgaaactttgtggttgttttatgtgtctagcacataaccatttaacaaaaacgacactatcaaggagtctaatatgactaaacattttgaacacaatgaatctcgccgtggctttatgaaattagttgcaggtgttggtgctggtttagcattctcaggttcaatcggtacttttgcttctaaagcctatgcagccccagcaaaaggcacgactattgaggcaggtattgcttatccgatttcaacaggttttgacccaatgagttcaactggtgcatcttcaatggcggctaatatccacatttttgaaggtttagttgatctacacccagcaactcgccagccatatctagcacttgcagcaaaagagccagaaaaagttgacgatgtaacttatcgtgtgactttacgcgatggtgctgttttccacaatggcacaccagtaactactgcagacgttgttttctcatttgaacgtgtattagatccaaataccaaatcactctttgctcaattcattccgtttattcaatcagtcaaagcgattgatgacaaagtggttgagtttaaattgaaatatccatttgcgttattcaaagaacgtttaaccattatcaaaatcgtaccaaaagcattaattgaagcccaaggtcaatcagtctttgatgcaaaccctgttggtactggtccatataaattcgtttcagcagtaaaagatgaccgtatcgtatttgaagcaaacccagcttatacaggtcaatatcctgcaactgttgagaaaatgacttggttcttactctctgatgacgcagcgcgtgttgcagcacaagagtcaggtcgtgtacaagcaattgaaaacgtaccctacttagatgcagctcgcttaaaacgtaaagcctctgtagaatctgttcaatcattcggcttaattttcttaatgtttaactgtgaaaaagcaccgtttaacaacaagaaagtacgtcaagcattacaatatgcgattgatacacaaaaattagttgatgtggtgttcttaggcaacgcaaaaccagcgacatcttatgttcaagattctcacccagactatgtgaaagcatcaacagtctatgatttcgatccgaaaaaagcggctgcattgttgaaagaagctggtgtagataaacttgaatttacaacacgttcaactgcacataaatgggttgtggactctgttcaaatgatccttgaagattggaacaaaatccctggcgtgaaagtgacaaacatcgcttcacaatcaccatacaatgacggtgttgatgctggtaactttgaagtgttaattgcaccaggtgacccatcagtattcggtaacgacttagacttattattaagctggtggtaccgtggtgatgtatggccgaaaaaacgtttccgttggtcaaatacacctgaatatgcagaagttcaaaaacttcttgacgctgccgtggctgcgaaaactccagcagaagctcgtgaaatttggggtaaagcgattaacatcattgctgaagaagcagcactttatccaattattcaccgtaaacttccaacagcttggagtaacaaagcattagagggcttccaaccactaccaaccacaggtatgtcattcattggtgtaagccgtaaataatcataatattgccttcaccttcgggtgaaggcgtttaaagtagcatcttacttaaggtttctttcaagcggtaagattgttgtaaaagttgcaaaccttttcggtaatctcaccgcttttcttataaaaattatataaacctatcccactaacctttcttgtagtcggagaaaaaaatggaaatcgtacttcgtctgttactacgtcgtttaatggcattaccactgatgatgcttggcgtaagtgcattagtttttatcattctacagttcacccctggagatccagcgtctgttgcattaggtgaaagtgcaagtgatgctgcgaaagaattgtatcgtgaacaacacggattgaacgatcctgttatcgtccaatactttcgtttcattggtaacgttttggtacttgactttggtctaaccacaccgccagaacagccaatcacctcattaattgctaaagccttccctctcacattacaactgactttcatcggggtctttttagcagcaatcgtatcattctctttagggattattgcggcactttaccgtgaccgttgggcagaccaagttattcgcttactctcagtggcggcggtggcaaccccatcattctggttaggtatcttattaattcaatacttctctcttgaattagattggcttccatcaggtggatttgtgccatttagtgaagacccaacagagtatttccgttcaatggcattaccatcattagcattagcaatcccagtatgtgcgtcattaattcgtgtggtgcgtaccacaatggtagaagaaatggacaaagattatgtgcgtacagcgattggtaatggcgtaccttatgcaacagttattcgtcataacgtattgcgtaatgccttgattacgccagttactgttttaggcttgcgtgtcggctacctacttggtggtgcagtggttatcgaacaaatcttcgacttaccaggaatgggtaaattgatttttaacggtatcgtaaaccacgacttacaccttgtacaaggagtcgtattgactatcgcctttactttcgtcttggtgaatatcattgtcgatattctttacttactgattaatccaaaaattcggagtttataatgtttcgccaaggattagctgatagacttgcttcaggcggggcaagatttaaagcattatcaaccgcctctaaactcgcattaggatttattgtgctcgtagcattactagctattttagcaccgtgggtatcaccatacgacccattgcaaacccttcgcccagttcaagcaccaaatgcagattactggtttgggacagaccgtcttggacgtgatattttatctcgcttaatttacggtgctcaaacatcactctttatcggacttggtgcagtagcacttgccattgtactcggcagtatcttaggggcaactgctgcgaccgcagacaagctcggtaacgaagtcattatgcgttttatggacatcttaatggcattccctggtattgcacttgcagcggtattacttgcaaccttaggtaacgcagtaccgattatcatcttagccattgcgattgtttataccccacaacttgctcgtgtggtgcgtgcaaacgtagtttctcaatgggaagaagattatgttcgtgcagaacgtgttatcggtggtagccgtacctacatcttagtcaaacacgttgtgcgcaactctgccgcaccagtgttagtctttgcaaccgtaatggtggctgatgcgattgtacttgaagcctctctctctttcttaggtgcaggtgtacaacttccacaaccatcttggggaaatatcctgtcagaaggacgtaacatcgtattaagtggcttctggtgggcaacaacctttgcaggtttagcgatactcttaacggtactctcgctcaacattctctctgaaggcttaacagatgcgttagtcaatccaaaactcaaacgtagcccaaccacatcaaaagaagacgtatcaaaaccgctttcaacggatgtacaagaagcaatggcagaaagtcttgcattaaaacgctacttactcaaattacacgagaaagaagctactcgcacagaccgtatgcaactaaacccaaatgccaaaccgattttacaggtaaaaaacctctcaatccgtttcccaaatcgttatggcgacattccacttgttgataatatcagctttaccgttaatgaaggcgaaacaatgggattagtgggcgaatctggctgtggtaaatctatctctgccttctcaattatgggcttattaccaccgacagccaaaatcacaggggaaattctctttaccgaccgtgcaggcaaccaacacgatctcttaaaaaccgataagcttaacgaattgcgtggacacgagatctcaatgatctaccaagatgctttaagtgcattaaacccatcaatgcgtatcaaaaaccaaatggcacagcttatcagccgtggaggtaaacaatctgctgaaaccctattaaaatgggtaaaacttgatccagagaaaaccttaaaccgctacccacacgaattatcgggtggtcagcgtcagcgtgtattgatcgcaatggctctagcgcgtgaaccaaaattacttattgctgacgagccaaccacagctcttgacgtaactgttcaagccgaagtgattaaattgctcaacgaattgcgtgaaaaacttggctttgcaatggtgttcgtgagccacgatcttgcattagtcgcacaaatggcgcaccacatcaccgtaatgtacgcaggacaagtagtggaaatggcaccgacatcatcgttattgtctaacccaacgcacgaatatacacgaggcttgctcggttctgtactctcaacagaatgtcgtgcagagcgtttatatcaaatcccaggcagtgttccatcgccgtttgattttgcgaaaggcgaccgctttgcaagccgttcattacgtccagatgcaaatccaaatcaacgcttgaaacttgtaccagcaagcgacaatccgaaacacctttgggcttcacatttggagggataaacaatgagtatgaaaccattaaaagaacagcctatcattgaattagagaacattgttgtacagttcccatctcgtgatggcacgctgtttaacccaaaaaaattcacagccgtaggtggcgtgagcttagaagtcaatgcaggtgaaacggtaggtttagtaggtcaatctggttgcggtaaatctaccctagcaaacgtgattatcggcttacaaaaaccgacatcaggtacagtcaaattcaacggcttacaaatgaaatacggtagtgcagaagctcgtaaacagtttggtcgtcaagtatcggtgatcttccaagacccagcgacagcgttaaaccctcgtatgcgagtattggatattttgaaagacccgatggatattcacaatgtactgcaaccgcacgaacgtgaaaaacgtgtttacgacttactctctcgtgttggtttaccacgttccgccgcacttgttgagccgactcgtttatctggcggacaaaaacaacgtgtagcgattgcccgtgcgttagcattaaatccaaaactgatcgttgcagatgaaccaacctcagcacttgacgtatctgttcgtgcgcaggtgctaaacctgttagccgatctgaaaaaagagttaaatcttgcgatggtgtttatttctcacgatttacaaaccgtccgccaagtttcggatagaattgtggtaatgaatggtggattgattgttgagcaaggtaatgctgccgatgtcttcgacacaccaaaagaagagtacaccaaaattttattagatgcagcgccatcgttattatagtttaattatgcgtctatctatgactgtttaagtagtcgttggtaggcgcatttctttttattatgaaggaaatacattatatgcgctgttattttctctttagtccaagtctagtgatgaacagcgttgccaaataatgggctttctgatgttcgcttgcacggcaacaatgggaataggcttttatagtagcaatgaaatcatgactattgggggaggcaagctacttaaacaagctatacctctcacaaatacactttatctaacagaaattcagactagaattgatgacgatactttttgaatttcaatgaaatggaatgggaagtcgttaaagaaaaaatggtctgaagtagatgaaaaaaataattgctgccgtgaccctatcccaaattctgtgtaaacacccatttcaacttaacggtgatcgtctaggcgatcaccaaaatcaatcataaatcgattcatcgccagtttccagttctgaatcggcattgtccatttttttgatgcatctttaatcgcaagccaaatcactttgaaaactgaatcatccgtcgggaatacatttcgttttttaatcacgcgacaaatcacgctattaagcgattccacggcattcgtggtataaatcgctttacgaatatcagccggataatcaaaaaatgtggcaatatttgcccagttatcttcccagcctttcgccacaagcgggtattttgcctgccatttttgcgaaagtgcggtcagattttcgcgagcctgtgcttcctccgtaggggcttgataaacctgctttaaatctgcggtgacggctttgtaatctttccacgaaacgaatttcaagctgttacgcactaaatgcacaatgcaaagctgaaactacgatacaatctaggtaaacaattggataaaccgcatcaagtgggcgattttgccatgccattacgcgctctttcaccgcgtcggtaacgcgagaaatcaggctggttgacacatccgcatcatagagttctttgaacatttcaacgatttcctgattacttaaccccttggcatataaggcaataatctgctcatccattcctgtgatgtgggtttggtttttcttgataagttgcggttcaaaggtgccgtcacggtcacgaggcgtctcaatttctatctcaccttcatcacaaatgacggtcttagatgtgtaaccgttacgtgcatttttaccttttctaggctgatgtttttcataaccaagacggtcggtcagttcaccatttaacgcagcctcgacggtgatttgcttgagcatccgtgaaaattgattgaggtcttctggtgtttttaggtttttggcaaattccgctgccaaggcgtgaagttgtttttcgttcataataaaatacctgtgtctgaatgtattatctcagaaacaggtatttacacaaattgtgggagaggctcttgctgccgtcgatttgtgattttatctcaacaatcctaacgctttaaataaatagtttgcgtcaagttatgtaaatatagccccactagtacgataattgagctcttacaatgaaacatgaaaaactatatttatatttacatctacttttatataactgccactttcctaacttaaatatattctaccttaataatatcaaattcaacatttccgccaggtgtttgtatatgtacattgtcgtcaatttctttcccaactaatcctcttgctataggagagttgacggaaattaagccatccttaatatttgcttcatcatcaccaacaatacgataagtcacacattcatctgtatttacattgagtaaagtcactgtagagccaaaaataaccttaccagtattaatcatattctttacatcaataatctgagcatttcccaatttgctttcaatttctttaattcgcccttcgcagaatccttgctgctctctcgcagcatgatactcagcattttctttcaaatctccatgttccctagcctcagtaatcgcactaattatttctggacggcgaacattctttaaaaaatctaattcttcacgtaattgctctgcaccacgcactgtcataggaatttgcttcatattttatccttaatagaaaagttcttaccaaaattagagaatgtcttggcagaaaaagagatataatctagtattagtcgactattattcattttctttataaaaatagcaaccttactatgatttcattttcgctcaaacaacttagaattttacttttaactcttttttatatgccttatagtgcttcagcagaggtcgatattacaccgttcatctctcatttacctaaaggtacatcaatcagtgttatcgctaaaaatttatctaccgatcaaattgttaccgattatcaaagtgatctgtttatgttgccagctagtactcaaaaagtatttactgctttagcctctaagatcatgctgaacacagattttaaatttcaaacagcgctcttgacgaatggtataattgagaatggggtgctagagggagatttaatcgccaaatttactggagatcctactttaactagcggtgagttatttcaactaatttcacaattaaaagaacagggcatacataagattagtggcaatttgatcatagatacatctgtatttgctagtcatgataaagccatcggctgggtatggaatgatctaagccactgttttagcgctccctcctctgcagtaaatatcgatcaaaattgtttttatgtgaatttagatgcaaatcaatctattggaagtctgattaaaattagcgttcctagcgcctatccagtacaagtatttagtagtgcctatgttgctgacaaatctgaagcaaatttctgtgaacttgatgtcgttgtacatgataacaatcgctactacattaaaggttgcttatctaaacaaactaaacctgttggattgagttttgccgtgcaagacactacaagctatggagggaatgttattaaagctaatttaaaacgtattgggattcaatttaatggtaatattcaacaacaaagtaaaccgcagcaaggcacattacttgcggaacatcattcagcatccctacaagagctcataaaaaaaatgatgaaaaaatccgataatcaaattgcggatgccttgtttagaacaatcgcaaataaacaatatcaccgcccaatctcattttctttggcaagctactttgtaagaaatagcctaaaatctaaagcaaatatagagtttaacaatagcatcatagctgatggatcaggtttatcaagacataacttagtaaatgcaagaacgcttttacaagcattagaagtaatagctagaaatgaaccaactttaaatttatttgaaacatttcccatcgcaggtgtggatggaacactttctgcgagaggttcaatgtcaatgcaacctcttgcaaaaaatgtaatagctaaaacaggcgcactgaaaggagtatataacttagctggatttatgactaatgcaaaaggagaacgtattgcttttgtacaatttattaatggttattcaacaggagaattagagagtaaaacccaaagaggacctttaacacagtttgaatataacttgtttatggcattatacaataattaaggatataagaccgacttaaacctgtaacaacagttgtataaatttgggtattattttgtatacaatgtttctttatttgtctattacccccttttgtctgctatgccaatttgtctattacaccacttttaaacaatattcgcttcggtttatttcaataaataaaggggcgacagccgcccctttaactttatgctcctagcaatttattcatccgtttaataaacgccgttggattttccaatgtgccacgttcagcgagtaacgcttgttcaaacaagagttcaatccagtcgttaaattctgcttcgtcagcaatatcagccatacgttttaccattgaatgttcagggtttaactcaaaggtatatttcacttcaggggcttgttgtcccattgcagcgaatagttttgccatttgcgtggtcatttcatcgctgtcagttgaaacaacggctgctgtgtcggtcaaacggtgagttaagaccacttttttgacacgttcgcctaaatagcctttggctctctctaagaagctcgcaaattcagcttcttgtgctttttgggtttcttcttcctctttgtcagcaagatcacctaaatctaaatctgatttagtaatactttgtaatggcttgccgtcaaattcggttaaatggctgataaaccattcatcaatgcggtcagaaagtagtaagacttcaatgccttttttgttgaacagctctaagtgtgggctgtttttcgctgcttgatagctgtcggcagttaagaagtaaatcgctttctgaccttctttcattcttgcaatataatcgctcaaactgaccgcttgttcgctactgtcagtatgcgttgaagcaaagcgaactaaggctgccacttggtttctatttgcgaaatcttcccctacaccttctttcaagactaaaccgaacgcattccaaaattgttgatattgttcaatgttgtctttcgccagtttttccaacatttgtaaggaacgtttagttagagctgtgcggagtgattgggtgactttgttctcttgcaaaatttcacggctgacattaagtggtaagtcgttggtgtccaacaacccacgcataaagcgaagataattcggcataaagacttccgcatcgtccataataaacacacgttgcacatagagttttaagccgtgtttttgttcacgctggaacagatcccaaggggctttacttggtacataaagtaggctggtatattcttgcttaccttcaactttattgtgcgaccaaattaacggatcggcaaaatcgtggctgatatgtttgtagaactctttgtattcttcatcagaaatctcatttttagagcgtgtccagagtgcttgagctttgttaattttttcccatttggtgccagtttctttgccttcatcgtcatactctttggtttgaatttccaccgctaaaccgatatggtcagagtatttaccgataatgtcacgcaaacgccactcgcttaaaaactctttttcatcatcacgcaagtgtaaaatcacgtctgtaccacgtcctgctttttcaatatcggcaacggtgtaatcgccttcgcctgccgattcccacaatacgccttgacttgcatcactgcctgcggctcgggtacgaacggtcactttatcagcaacgataaaagaggagtagaagccaaccccgaattgcccgattaattgactgtctttcgcttggtctgaaccgagtgcatttaaaaactctttggtgcctgatttagcaatggtgccgagatgatcgatcacttgctcacggctcataccgataccgttatcgctgatagtgattgtgcctaaggcttcatcaatactgatacgcacacgcaattcaccgtcgccctcataaagttcaggttgagaaagagctttgaaacgcaatttatcagcagcgtccgacgcattggaaattaactcacgcaaaaagatctctttattagaatagagtgagtggatcattaattgaagtagttgtttgacttccgactgaaagccacgggtttcttggtttgtactcatattgtttcctttatgatatatagaatgatcgatattcttccccagcttgcgggggaagtggttgagcaaagcgaaaccgatgggggattgtttgttagccctcatcccccttgcaagcaaggggacttcccccataaatgggggaagaatataaaaaataacgccctactaaatagggcgttattcttaaatttcaagggaattatttggcattatgtaacattataacgaatgtagtagggacgccacgcttggcgtccgtttcccatattggctaaaatgttgatatttatggacgccaagcgtggcgtccctacatttctagcgggaattattcatcttccgtaaagcgttttgccttatatttcgggttcatcaagttttcgaccgataaaatatcatctaattgagcttctgtcagcaagccacgctctaacacgacttcacgcacgcttctgcctgtggttgcacagattttaccgacaatatcgccctcgtggtgtccgataaacggattgagataggtcacaataccgatagagttaaatacataaccttcacaaatctctttgttcaccgtgataccgtcaatacatttatcacgcaagttcacacaagcatttgccaagatgtcgatagactcaaacatcgcttgaccgataacaggttccatcacatttaattgtaattgccctgcttccgcagccaaggtaatacaagtatcgttaccgataattttgaaacatacttggttcaccacttctggcacaactggatttactttcgctggcataatcgaagaacctgcttgtaattcaggcaagttgatttcatttaagcctgcacgcggacctgatgaaagcaaacgtaagtcattgcatactttagataatttcactgctgtacgttttaatgcaccgtgaaccatcacataagcaccacagtctgatgtcgcttcaattaagttttctgataatacacaaggcagttgggtcacttccgcaaggtatttcactgcaagcggtgcgtaaccttcaggcgtattcaaacctgtaccgattgccgttgcccctaagtttacttcaagcaacaattctgcggtacgttttaagtttttcacttcttcatctaacagcacagaaaacgctttgaactcttgcccaacggtcattggcacagcgtcttgcaactgggtgcgtcccatttttaagatatttgcaaactcattagctttattttcaaaaccgtgttgcaagtaaagtactttgctgattaattgcataatgctgttgtaaacggcaatacggaaacctgtcggataagcatcgttggtagattggcttgcattaacgtgatccattggattgatgatgtggtattcaccttttttatgccctaataattccagtgctaagtttgccaccacttcattggtattcatattcaccgaagtacccgctcccccttgatacacatcagatgggaactgatccatacaacgaccattcactaaaatctcatcacaggcttgcacaatcgcttttgcaattttcttcggaattgctcctaactcgccattagcaagtgcagtcgcctttttcaccattaccataccacgcacaaactcaggtacatcagaaatggtatttttagaaatattaaaattttctactgcacgtagagtatggataccccaatacacatcattagaaacttcacgttcacctaatagatcgacttcaatacgggtattgctcataagattatcctcatcattttgtgatttactgaattgatgcggagatcataccgagagcgaaagggaaaaaatgtgatctagatcatattttcaaaatggagctgggcgatataaattgccgtttcggattagttttttttatgataaaaagccctttgagagcaaagggctgaaacatgttctacagatagattaatcgtcaattgcatacccctgtggcgataataactgattatctaaataggctttaccttcaataagttttaatctatcgtcacagaaccattgcaccacaagcggataacagcgatgctcttgttcataaacacgctcaatcacatcatctaattcatcatcaggataaatcggcactttcgcttgtagaataattgcaccgccatcaacttcttcattgacgaagtgaatggttgtgccgtgttcggtatcgcctgcgtccattgcccgttgatgtggatttaaacctgcatatttaggcaaaagtgatgggtgaatattgagaattttacccgtaaagcgagcggtaaattcaggagtaagaattttcatatagccagctaaaacaattaaatcggcttgtaatgcttcaatttgttctgcaatggcattatccatttccagattatctgaaaagtcttttttggtaaaaataaaggtggaaatccccgcttgtttggctctttctaagccgtaagcagtcgctttattagatataacagcacaaattctgccgttgatttttccagtatcaatagcatcaataatagcttgtaaatttgagccattgcccgaaatcattacgacaatatttttcataatatcgtctccgttatcacattttctttccatattactatagttatcctattacggtataaactaagttaaaatctaagctcttttcaaaaattctgatttcaataaaagttttccacaatctacattgtgctcaccagcgactagatgaatccctttatatttagttccttttttcagtacttctgaggatcctttcaattttaggtctttaattaagataacatcgtcaccgtcagcaagtaagtttccattgctatcctttacgatcaattgatcttcatcgacttcaacttcattaccagtccattcgtttccgcaatcagggcaaacaaattgaatggaatcgtggtaagtattttcgcttttacaagcagggcaaatagggtaatccataattatcctcaatagatttaaaaaaacgctattctactacaagtggtaaaatttgagggattttttgtaaaaatgaataaaaaaattggggtattaaataaataccccaacaacgaaaaataatttactgcaacaccgcaatatatttcaacatcaccccagcggcaatcgctgaacctattaccccagcaacgtttggacccattgcgtgcattaataggaagttctgtttatctgcctcaagtcccaatttatttgatacacgagcagccataggcactgccgatacgccagctgaaccaatcaaaggattaatcgggttcttactaaaacggttcattatttttgccataatcacaccgcttgcggtaccaataccaaaggcgataatccctaatgccaaaatacctaaggtttgtggttgtaggaatttatcggcaattaatttagaaccgacagataaacctaggaaaatcgtgactgtattgattaatgcattttgagcgacatcgcttaatctttcgactacaccactaactcgcattaggttcccaaaacagaacatacctaacagtggagcagcatcaggaagcaataacgccaccaaaatcaacagcacaatcggaaacaacactttttcacgcgtgctaacatttcgtaactgcaccatcttaattttacgttcttgctctgtcgttaaggcacgcataatcggtggctgaattaatggcactaacgccatatacgaataagcagccactgcgatagcgcctaatagctcaggagcaagtttgctggcaaggtaaattgcagttggaccgtctgccccaccgataatcccgatggctgccgcttgtggtaaagtgaagtcaatcacacccaaccagtttaagcccactgcccctaataccgttgcaaagataccaaattgagcagccgcccccaataacaatgtttttggattagcaagtaaaggcccaaaatcggtcattgccccaacgcccataaagatcacaagcggagcaacgcctgaattaattgccacttggtagaactgagccaataccccagaggtgtaacccatatcgccagctaacacttctaattcattgcgaaccgatggcaacgccagccccaaagcctctttgaccgcatttggatcgacttgcgaacccaatttctcagcaatcaccaccagctgttgtgtagtgccactatgcaataaattatcaagcgcagtcattgcaagtccagcctctggaatattcgacagcaatccaccaaagccaatcggcaacagcaacaacggctcaaactgacgggcaatggcgagccaaagcaacaagagactaatggcaatcataatggcttgccctagttcaagatgcataatccccataccctgaattaacgctaacacactttccatatttccccctagacgatttgcattagggtatcgcccacgccgaccacatcgccagatttcactttaattccttgcacagtacctgcttttgctgcacaaatttgggtttccattttcattgcctcaagaataagcaacacatcgccctcagcgacttgttgtccttcggcaaccaccactttaatgatattacctgccatcggtgcattaactggctcgcctgaaccactcgcggtagcttgaggggctagatttgccactggggttggggcagtaacaggggcaatgttactaatatccccaccctcactcactttcaccacaaaggctttaccctctaattccacggtataaaccgcagccccaacggacgaagctggtttctcgactttgctttcaacagctttagcggtttcaagagttggtgcaggctcgaaagcggcaggattgccacggttttctaagaacttccaaccaatttgagggaataacgccacaatcaacgcatcgtcaatctcatcttttgtaagtgtaatgcctttttcgaccgcttgttgtttcacttctgccaaaagtttatccatttcaggggcaagatgatcggctggtctatcggtaatcggctctcccccctctaacacacgagcttgtagttcagcattcacaggggctggcgtgcgaccatattcccctttcaaaatacccgcggtttctttcgcaatatttttatatcgaccgcccattaacacatttatcaccgcttgcgttcccacaatttgcgatgttggtgtaaccagaggaatatagcccaaatctttccgcacttcagggatctcttttaacactaaatctaatttatctgctgcattttgttgtttgagttggctctcaaggttagtcagcattccacctggcacttgagctaccagaatacgactgtcccccccttttaactgaccttcaaacttcgcatattttttacgcacctcacggaaatatgccgcaatacgctcaatttgcggaatagctaaacctgtgtcatacggcgtaccttgcagtgtcgccacaattgcctcagttgcagggtgtccataagttccactcattgatgaaatcgccgtatctacgccatcaacccctgcctcaatcgcttttaataacgccatttcagacatacccgttgttgcgtggcagtgcaagtgaagttgcacatcgtagcatttcttaatttcactgactaactcataggctgccatcggcgttaaaatccccgacatatctttaatcaccagagagttcaccccaatttcaagcaattgctctgtcacatcaagccaagtttctaacgtatgcacaggacttgtggtataacttaacgttccttgagcgtgtccgccgtttttacgcaccgcttgcagagcttgtttcatatttcgaggatcattcattgcatcaaacacacggaacacactcattccatttgctacggcacgttctacaaagcgatcaaccacatcatcagcataatggcgatagcctaacaaattctgcccacgcaataacatctgaagcggtgttttcggcattgcttttttcaattcacgcaaacgaacccacggatcttcccctaaaaaacggatacaagcgtcaaaagttgcaccgccccacgcttctaatgaccaatagccaatctcatctagctctttagcaatgggtaacatatcttccaaacgtaaacgtgtcgcaaataaagattgatgagcatctcttaacacaacatcagtaatggcaatttttttcggttgaatagtcatattattatcctcttagtgaagtccttgagttcgacgatggtgagcaatcgcagccacaataacagggcgtaaacgttctaaatcattaggaatggctggttgcggtgatggttgagtagtttcaacgacaggttcagggaaatagcgattaatcagatgtgacattagctgaatagccagaataagtaagagcaggaataacatcacaaatcccattccaacaaacatcagatttagtccttccgtgataagttcagtttcagtcatagattgtcctctgaaaataagaagagtaaacaatgtaaggaaatttatgttttttttctataacttaaatcaaaagattttgtttttttacaaagaaatattcccttttcataacaaacttaaataaattccaaaatatctagcaacaaagctagttgcggaaataaacaagattctgacataatataatttttaatgcttattaaatataatgaaactttatattgataattaataaattatagaaacacaacatcaaaatttggagagattatttatgcctaaattacgttcagcgaccagcacacaaggtcgcaatatggctggcgcacgtgcattatggcgtgcaacgggaatgaaagaaaatgactttggtaagccgattattgcggtggtgaactcatttacccaattcgtaccaggacacgttcatttaaaagatatggggcagcttgttgccgagcaaattgagaaagcaggtggcgtggcaaaagagtttaatactattgcggttgatgatggcattgcgatggggcacggcggtatgctttattctctgccgagccgtgatttaattgctgacagcgtggaatatatggtaaacgcacactgtgctgatgcgatggtctgtatttcaaactgcgataaaattaccccaggaatgttaatggcagcgttgcgtttaaatattccaacgatttttgtgtctggcggcccgatggaagcaggtaaaactaaattatctgatcaaattatcaaattagatttagtcgatgcgatgatccaaggggcgaacccgaatgtgtctgatgatgtaagtgatcaaatcgaacgatccgcttgtcctacttgtggctcttgttcaggtatgtttacggcaaactcaatgaactgtttaaccgaagcactgggtttaagtttacctggcaacggttcttgtcttgcaacccacgccgaccgtaagcagttatttttagacgctggtacgcaaattgttgagctatgcaaaaaatattatgagcaagatgattgctctgtattgccacgttctatcgcaactaaggatgcatttaacaacgcaatgagcctagatattgcaatgggcggttcaaccaatacggttttacacttacttgctgcagcacaagaagcggaagtggatttcacgatggcggatatcgatctcctttctcgccaagtgccttgcttgagcaaagtggcaccaaatacagcgaaataccacatggaagacgtacaccgtgctggtgggattatggcgattttaggtgaattagatcgtgctggcttgctcaacaatcaaactcgcaccgtattaggtttaagccttgcggagcaaattgcgaaatatgacatcgttttaaccaaagatgaagcggtgcataaattcttccgtgcaggccccgcaggtattcgtacgactaaagccttctcacaagacacccgttgggatacggttgatgatgaccgtcaaaacggttgtatccgtagcaaagagtttgcttacagccaagacggtggtttagcgatgttatcgggcaatatcgctttaggcggctgtatcgtaaaaaccgcaggggtggacgagtcgatcttaaaattcaaaggcgaagccattgtatttgaaagccaagaagatgcagtttcaggcattttaggtggaaaagtgcgtgcaggacacgttgtagttatccgctacgaaggtccaaaaggcggaccaggtatgcaagagatgctttatccaaccagctatttaaaatcaatggggttaggcaaggcttgtgccttattaacggacgggcgtttctctggcggtacatcaggcttatctatcggacactgttcaccagaagcagccgcaggcggtttaatcggtttagtgaaagacggcgataccattgacattgatattccaaaccgttcaatccagctggttgtgcctgacgctgagcttgcccaacgccgagcagaacaagatgcgaaaggctggaaacctgcaaaccgtcagcgtgaagtctcttttgcattaaaagtgtatggacattttgcgacatcggcggataaaggtgcggttcgagataaaagcaaaatttaattaaacacaagcggggggatctttctgacattttgcaaaatgagaagaaaatctcaccgcttgtcaaattaggaggctattattaaaaagtccttcattgcaatagcgatttcttctgtgtttttttatctgcttgtgacgataaagaaaaaaatactttggctgcccaagttcagcaatctgcacgggaaatttctcaattaaaaagtgagttagaaaaagcaaaatctgcttttccgaccctaaaagttgagatcgaaacactttttgataagaaagaagtggtaaaacataaaaaagatccgaatgaatcagatgagtttttccgtgaaaaaacgccagtacatttaggtattactcttcctaagaccaacatcgagtggttagatgcgttaatttatcacgactttattcaaaattggagcggagaatttgatgctcaaggcaataaaatttcaccaccaaaagtagaaaaaggcaaagagcgtgaaatggtattaaaggctattcaaaaacagtttgatgtaatgattgctgaggcgaaagaatatccagctatcggatatacggaagtgatgaacagtaattatgtctatcagcgtaataatttagtggtcttttctcaattttataatatctatacaggcggtgcccatggaatgtatagcacaagatacttgaatattgataccgataaacaagctattattaagttagttgatctcttgtcagaaaaagaacaagcggcattgaaagaaacattatggaatcgttatgtggacgaatggatgctattatctggtggtaatagtgaaccctttactgccaaagcagagttaattttctccgatgaattctatttttcagaatcaggcattacatttgtttatcctccttatgcattaggtccttttgtaatgggtgaagtagaactgacattatattggagtgagattaatgagttcttaccgaaagagtatcaagggcgagacaaatatattgaggcagatctttaaggattaatggtatagcaatgttagatcactttttatctttaccccttgcaatgtaagtactgctcgccgggttgtttacttggttttgtaccattttggatcagcctttgtctttttctttaaaacggtaaatcgcaaaattttaaatttacactcagtttaatgcttggttttgtgataatttaatgcttggttttgtgataatgatgatacttgatgtcgcattggggtaataaaagatagacatcttccttgtgaaaatccccctttttacctacaatatccccttttatttattgaacaaaaactatgtcgcaaattaaattgattgtcgggcttgctaaccctggtgcaaaatatgaagaaactcgtcacaatgcaggcgaatggctagtgaacgggcttgctcgtatgtttaatgtcaccttaaaagaggaagcgaaatacttcggcaaagtcgctaaaattaacacgccacaaggcgaagttcgtttgcttgtaccaaccacgtttatgaatttaagtggtaaggctgttagcgcattagcgaatttctatcgcattaagcctgaagaaattttagtcgctcacgatgaattagatcttcccccaggtgttgccaaaatcaagcaaggtggcggacacggcggacacaacggtttaaaagatattattgctgctcttggtaatagcaataatttctaccgtgtgcgtatcggaattgggcatccagggcataaagacttggtggcaagttatgtgttaggtaaaccttcgctaacagatcaacctttaattaatgcggcggttgatgaagccagtcgttgcgtggaactgctgttcaaagagggaattgttaaagtgactaatcgtttgaatggttttaaagcgtaaaattgattgaataatgatagtagggacacactgcgtgtgtccgtatctgtttttttcggacacactcagtgtgtccctacataataggaaaatataatgggatttaagtgtggtattgtcggtttaccaaatgtgggtaaatcaactctttttaatgcattaaccaaagcgggtatcgaagcggcaaactatccgttctgtaccattgaaccaaacactggcgttgtacctatgccagatccacgtttagatgcgttggcggaaatcgttaaaccagaacgtgtattgccaactacgatggaatttgtggatattgcaggcttagtggctggggcaagtaaaggcgaaggtttaggtaataaattcttagcaaatatccgtgaaaccgatgcgattggtcacgttgtccgctgttttgagaacgatgatattgttcacgttgcaggcaaaatcagtccacttgatgatattgaagtgatcaatacggaattagctttagcggatttagatagctgtgaacgtgctatccaacgtttacaaaaacgtgccaaaggcggcgacaaagacgctaaatttgagctttccattatggaaaaaatcctaccgaccttagaaaatggcggtatgatccgttctgttgagttggataaagatgaactgcacgccatcaaaggttataacttcttaaccttaaagccaaccatgtacattgctaacgtgaatgaagacggctttgaaaataacccttatttagatcaagtgcgtgaaattgcggcaaaagaaaatgcggtagtcgtgcctgtttgtgctgcgattgaagcggaaattgctgaacttgacgatgatgaaaaaattgagttcttacaagatttaggcattgaagaaccaggtctaaaccgtgtaatccgtgcaggttataagctattgaatttacaaacttactttaccgcaggcgtgaaagaagtgcgtgcttggacggtgtctattggtgcaacagcaccaaaagcagctgcggttattcataccgactttgagcgtggctttatccgtgcggaagtgattgcctatgaagattttattcaattcaaaggtgagaacggcgcgaaagaagcaggtaaatggcgtttagaaggtaaagagtatatcgttcaggatggcgatgtaatgcatttccgttttaatgtttagtctacttattcatcattttgagtagattagttttcaaaaatatgtaacaaaaattttttgcaaatctcaccgctttcctttacaatcgccaagctttttggggctgatcttggattcgacgggattagcgaagtccaaggtgcacgtcgaggtgcggtaggcctcgtaaacaaaccgcaaaaaatagtcgcaaacgacgaacaatacgctttagcagcttaataacctgctcatagccttatcgcctcagcttccgctcgtaagacgaggagttcgataagtcacccaaaacgagatcgtgtggacgccgccgtttgaggatcgaaacactaaattaaatcaaactagcttattctttgcgtgtctgtccgctgggggtaagcgaaattaaagactagactaaacgtgtagtgctgaagatggagtaatttcggacgggggttcaaatccccccagctccaccaaatcgacataaaccaacgtaaacgaacgtaacaagaagccttgaaaatcaacctttcaaggcttttttatttctcttaatgtaactcgacgtaaacggaaataatagacttttagtaggacgtttagtaggatcgctctcatatatagcaaaagccgtcctactaaggtgacagttatggctagaactacaaaaccacttacaaacacagaaatagcaaacgccaaacccaaagataaaaaatatcctttaactgatggcggaggcttgtttttacttgtaaagccaaatggggcgaaattgtggcgttttaattactataaaccatacacaaaaaatagaactgaaataggcttagggaggagcctctcccacaatttgtgtaaatacctgtttctgagataatacattcagacacaggtattttaattatgaacgaaaaacaacttcacgccttggcagcggaatttgccaaaaacctaaaaacaccggaagacctcaatcaattttcacggatgctcaagaaaatcaccgtcgaggctgcgttaaatggtgaactgaccgaccatcttggttatgaaaaacatcagcctagaaaaggtaaaaatgcacgtaacggttacacatctaagaccgtcatttgtgatgaaggtgagatagaaattgagacgcctcgtgaccgtgattggattgctgaaaatgagggtgcgaagttctgggcgaatgtgctgacagagcttcaaaatcgaggcttgaaagacatttttattgcctgtgtagacggtttaaaaggcttcccggaagccatcaatgcagtctatcctaaaacgaagattcagctttgcattgtgcatttagtgcgtaacagcttgaaattcgtttcgtggaaagattacaaagccgtcactgcatatttaaagcaggtttatcaagccccgacggaagcacaggctcgcgaaaatctgaccgcactttcgcaaaaatggcaggcaaaatacccgcttgtagcgaaaggctgggaagataactgggcaaatattgctacattttttgattatccgactgatattcgtaaagcgatttataccacgaatgccgtggaatcgcttaatagcgtgattcgtcgcgtgattaaaaaacgaaatgtattcccgacggatgattcagttttcaaagtgatttggcttgcgattaaagatgcatcaaaaaaatggacaatgccgattcagaactggaaactggcgatgaatcgatttatgattgattttggtgatcgcctagacgatcaccgttaagttgaaatgggtgtttacacagaatttgggatagggtcaaacccagcctatttaaaggtggctgggttttgcaagtgatgtactaattgcgaattttattgagctaaacacccaccaaattgatccgccaaagattgtaaaaattctggataggcgtttttacttaagtcaatttttgcccctaatggatctaattgccctactttggctgatgtgcctttgcttaagctctcaatcacttttggtgtgaattgtggctcagcaaataaacattgtgcttttttctgagcaatgcttttcttgatggcatttaaggtttttgcccctggtgcaacagttgggtttattgtgaatgaacctaatgatttcaatccataagcatcttcaaaataaccgtaagcatcgtggaaagtgtagtaaccttttgattttacaggtgctagctgttttgcaatctcgctatttttcgttgccaatgtcgttttaaaattcgctaaattctctgcaatttttgctttttgttcaggtagttgctggcttaaacgctcggcgatttgttctgcgatatgttcactcgcttgaggtgataaccaaatgtgccaatcttcgtcgtggttatgcccatcgtggctgtgggcgtgatgagtatgattgtgggaatgtccgtgcttatgctcgtgatgttcctctttttcttcacctgaatgttccacaagctctttaattgctggcacatcttcaagggttaagactttctcttttggtaatttctcaatacttttctctaaaaaagtttccatctcttccccaatccatactacgagctgtgccgattgaagttgttcaacatcagagggttttaggctgtaatcgtgtggcgaagcactggttggcaatagcactttagtttctgtgacaccatcggtaatcgcgttagcaataaaacctaacggtttgactgtggttaaaacatcggcattagctactgcagttgcccccaataatgcaaggcttaataaactttttttaaacatagaagatctcctctcaaataaatcggtgagatcttagcagaatattgcaattaatctataatttttttatggttattagcattaatcacaaaaaaataaggacacccaaaagcgtccttataaaactgacggtaaaactacaacaacatcttcacaatcttatccaatttcacccgtccaaattttttcagtaattttttcactttttcggggtagtcttttagctcttctaaatcgctataatgggttaagactgttgtatgtgtacgaatttgtgctaattcaccttgggctttttcactcagctcaccctttggatcagaaatcaacacggcattttctgcatctaatttccacgcacgtgggttgagattgtttcctgtgagtaggatataacgttcatcaatccatacgccttttaagtggtagctgtttttaccatctttccacaagcggatcgttaattgcccattttggatataatgatcaaactttttcgtaaatgctcgcagatttttttcatacagatacggcaaagcggacgccatcgtaaatttttcttctggtggcgtgaaaaaatcgttcgccgttttatcgccgacaataatttcaatttgtttaccattttccaacaaccattcaattcgctggttaattgaacgagggaaattgaaataaggcgtacaaatcgtcaatttttgttgtacttggaaaaacagcgcttcaatcgttttattcagcggatttttacgccctaaacccactaaaggtgaaagcattagctgttcattatccattgactgaccattaaaacgatattcttgttggctaagctccttacggaaagctttcacaagtggtcgaattccaatggtttttgggcgatttgcttgatccaagcgatttaccgcaggattgctcaatatattttgctgaataaaattgacccagctatctgctaaagccttattttcaatttgatggtaacggtcgtaacggtaacgctcaaactgctgtaaatagacgttgttaatgctcgctccgctataaagcagcgtatcatcaaacacaaaaccttttaggtgcaacacaccgaagatctcacgtttattgacaggaacgccataaaatgcaatctcttgctccgtcggcaaggcatattgctcacgcatctgggtgtaccaatcggcgtttgaactttgggttgcttcgccaatacgtccacgttgcgccctatgccaatccacaaggattttgatttctagttgtgggttagctaatttcgcttgataaagtgcatctaagatctcttgccctgcttcatctttttcaaaatagagagcggtaagataaatacgaaattttgcttgttttattaacgctaaaatgtgttgtttaaactcggtgctactggtaagaaaatccactttttctaccgcttgggggataaaagtgagattatctaagtggcgttttgcacgggtttgtttgtttagaataagcatcttatgctccatttttctttacttcatagatagtttctacgcagtaacactatccctacttttctttgcttcgccaaagaaaagtaggcaaaagaaaggcgaccccgagcgtttcttcttcctacgcttgttgctaatttttgggacgaacttttcaaactcgcttgcttcgcaagctcaaacacgaaaagttgtcctcaaaaatttacgcaaccgcttcggcgaaacgcaggggaattgatcgaacatctcgatctcaactttgcaaaaaattaactaaaacttaccgcttgtttggcggtttgggttcccttctgaaccgcctgagcgtgtttaaatttgtaggaacatttttctctgagccaacgaagttggcgaatttaaaatgttccgttaagcaaatttaaactaagcgaagataagcggtgaagtagggttgcctttcttttggttacttttctttggcaaagcaaagaaaagtaacaaaattaagcgatgatgaaactacgcaaagtttcttgtttcaccttccccaaccacattctccacacaacgcccacaaatttcagcgtgttctgcattcgcaccaatatctgtcgcatagtgccagcaacgtgggcatttttcaccgtctgcacgttctactttcaccgcaagaccagctaattcgccttctgcaacatcagattctgaaagtggtttaacaatcgtttgtgaagtgattaacacgaaacgtagctcgttgcctaactgttctaacagtggacgaatatcatcatttgcataaacggtcactttcgcttcgagaccagcaccaattaacttgtcgttacgcgcttgttccaagacacggtttacttccgcacgcacttttaacagtttttgccagtagttgtcatctaatttgtcgctttcacttaaaccgaataagcctgtgtagaattcttcagtaaagacaaattcagaacgcccttccacttgtggtaagtagccccaaatttcatcggcggtgaaggataaaatcggtgccatccaatgtactaatgcttcagagatatgccacaacgcagtttgacagctacggcgtgcaaggctgtctgctttggtggtgtattgacggtctttgataatatctaaatagaacgatcccatttcgattgaacagaaacgcattaaacgctgaacaacggtgtggaattgataattatcataggcttctttaatgtcgttttgtgcatctaacgcacagcttaccgcccaacgatctaaggcgatcatttcttccggtttaaccaaatcacgttttggatcgaagccatttaagttcgctaataagaagcgagcagtattacgaatacggcgataagtgtcgcctgcactgtttaaaatgttgtgcgaaacggcaatttcacctgtgtagtccgtagaagcaacccataaacgtaaaatatctgccccatttttgttccatacttcacttggcacaatcacgttaccgagtgattttgacattttgcgacctttttcatcaacggtaaaaccgtgtgtaagtacttgattataaggggctttattatcggttgcggtagaaagcatcaatgatgacataaaccaaccacggtgttggtctgaaccttcaaggtacatatccgcagaattgccattaaactctggacgttgttgtaccacagacgcataagtcgatcccgagtcgaaccatacatcaagggtatcaggtactttacgatagattttcgcatcttcttcgcctaacacatctttcggatctaaatcccaccatgcttgaatgcctgcttgttcgacacgttttgccacttcttcgagaatttctaaggtgcgtgggtgcaactgttctgtttcattatgtacaaacattgtcatcggcacgccccaagtacgctgacgagagatacaccagtcaggacggttcgccaccattgtatcaatacgcgcttcaccccaacttgggatccaacgaacacgtttaatttcgcctaatgcctgtttgcgtaaaccttgcgtttccataccgataaaccattgcggtgtcgcacggaaaataatcggggttttgtgacgccagcagtgcggatagctgtgtttgatacgctctaatttgagcaacgcccctgtttcttttagtttttcaaggactaaatcattactttcaaacacgcctttacctgcaaagaatggagtagttgaaataaatttgccatcatttgccactaatccagccatttctaatttatatttttgacccacaatatagtcgtccaaaccgtgatctggtgcggtgtgaactaaaccagtaccgccatctgtggtaacgtgatcgcctaaaataaacggcacgctaaaatcgtagaatgggtgattgaaacgcattaactctaagtcacagcctttcgctgaacctaacacttcaacttgctcaacgcccgttactttttgtacggcttccactaattctgtcgcaagaataacacgctcatcgccaaactgtacgagctgatattctaattccgaatttaacgcaatcgcacggtttgacggcaatgtccaaggggttgtagtccaaatcacagcagaaatctgaccgcttcctttgccctgagcattaaatttcgcttccacagcaacaggatctaccgctgaaaaacgtacatagattgatggtgatactttatcttcatattccacttcagcttcagcaagggaagagccacagtctaaacaccagtgaactggttttgaacctttgtataagtgaccatttgcaatcactttacctaatgtacggataatatgtgcttctgtatcaaaattcattgtgagataaggattatcccaatcgcctaaaatacctaaacgcataaaatctgctttttgaccatccacttgctcttttgcatattcacggcatttttgacggaattcagcggttgaaatattttcgttcggtttacccaccaaaccttctacttttaactcaatcggcaaaccgtggcagtcccaacctggtacataaggtgtatcaaagcccattgcagttttagatttgttaataatatctttaagaatatggtttacagcgtgtcctaagtgaatattcccattcgcatacggagggccatcgtgcagaataaaggatcttttcccttttgatgcttcacgaattttttgatagagctttttgtcgtgccaattttgtaacatcgcaggttcacgcttagcgagatccccacgcatcggaaagcctgtttcaggcagatttaatgtgtttttgtaatcagtcattttgttgttccaattaataaaattaaaagtctttatgaaaaataagtaagcggtagaaattacccactattttgcaaaatagatcgtactatttggtttacctcttgatgatcttttatttgataaaggtaaatatttttatcctgttttaactgtgcaaggcattgttgataatttactgccattcgttcaatcacttctcgctcaacaattcgagggagagtgccttctatattacgcttatcctcaaaccgttatctattacgcataatactcaattctgtgtttgaaggtaatgcaagaatataaatttgataatcctgattttttaattctgataataattctattgctgtatcaatattattaaaggttgtttcatatattatattcaacctattttcagtcgcttttttcaataacccctttgctactcgatgagcaaaattgcccgttttttatgagcattatctctaccatatttttcaatgtattgacttattttagggtgaatacgtctataatcatcagcttgaatagggaaataatttaactcaaaattatcatataacaacttaatacaagttgattttccactaccactcacacctgcgacaatgatggcttttggtaaatctattgaggttaaaccttgaacaaaaactctatcatcaaagagtgcttgaatttgttcttctgttggtttgacctctctcaccataatcaatgttccaaacgcaatttttgatatttatcttgcaaaatcagcacctgttcaacaacagggatcacgtccatataatgttcaggaattaaactaaaatactctaattctaaatggtgtaattgaatacgatcactttttcctatttcagtctgtaatgcccctgtcattagcatatcagcaaaagtatccgcacaaatttcgtggaaaacatcactaaacggcacataatcttgctgtaaactggctaaaatttgggcttttctttcttctgttaatctcattttatacctcttgaaagaataatctcaccgcttgtacatctttctcaatttgcaattttaactcatcaaaactcgcaaacttaatttctgaacgaaccttctttaaaaaacggacttcaatcgcttgcccataaatagaattatcaaaatcaaacaaatgtacttccaataacggctttgtcccatttatcgttgggcgattacccacattcgcaataccattaaaaatccctgctgatgtttttactttgactgcataaacaccctgaatagccgttactaaacgatttagcatcagatttgccgtcggaaaaccaatggttcgacctaacttattaccgtgagcaacacgaccacaaattgcatagggttttcccaacattttttctgctaactgcaaattatcattatgtaacgcatcacgaataagtgaactactaatccgctgttgctctaaacaatggctgtgcgaattttctacgtcaaacccaaattgctttcctgcctgttgcaaactatcaaaagtccccgaccgcttgtagccaaactggaaatcgtcaccgacacttaaatacttcacattcaacttatcgactaataaatgttgaataaattgctctggttgtaattgagcgaactgagcattaaaacgcacacaaagcaaataatcaaaaccgatttcttgtaaggcgtgaattttatcgcgtaaacgcatcaatcgtgcaggagcggtcagtttatcttgttttttggcaaaaaactcacgaggctgaggctcaaaaatcatcaccactgacggcaaacgcaaggcatttgctttctctagcaaacgcttcaaaatttgctgatgccctaaatgaacaccatcaaaattgccaatggttagcacacagcccttagaaaaatcagcacagtgagctaaattatgcacgcctcgaattaattgcatcggataaaaatagattacgttttcaaacaaaaattatgcccgattatacgaggaatggggggaaatgaaaagaaaagcataaagatattttggcgatctttctagcttatcttggtataattactgtacgcaaacgtttgcttaatgttatacttatgaataagtttttttatttaagaggattgctatgacagttacacaacttagttataaagacgctggtgtcgatattcacgcaggtaatgaattagttgaacgtattaaaggcgatgtaaaacgtactcgtcgtcctgaagtaattggtgggttagggggctttggggctttatgtgccttgcctaccaaatataaagagccgattttagtgtctggcactgatggtgtgggtacaaaactacgtttagccattgatctaaataaacacgacactataggtatcgacttagtcgcaatgtgtgtgaatgatttagttgtgcaaggtgctgaaccgctgttcttccttgattactatgcgacaggtaaattagatgttgatgcagcaagctctgtcattaaaggcattgccaatgggtgtgaacaatccggttgtgcattagttggtggtgaaactgcagaaatgccagggatgtatcacgaaggcgattacgacttagcaggcttctgcgtaggtgttgttgaaaaatcagaaattattgatggctcaaaagttcaagttggcgatacgctgattgcattaggttcaagtggtccacattcaaatggttactccttgatccgtaaagtgctagaagtgagcggtgcgaaaccaacggatttactcgaaggtaaaccattgagtgagcatttccttgcaccaactaaaatctatgtaaaatcggtgttagagttaatcaaacaagcagaggttcacgctatcgcacacttaacaggtggtggtttctgggaaaatatccctcgtgtattaccagccgatgtaaaagctgtgattaatgaagcaagctgggaatggttgccatcatttaaatggttacaggaaaaaggcaacatcagccgttatgaaatgtatcgcacctttaactgcggtgtaggtatggtgattgctctacctgaaaaagatgtcgaaacggcattaacagtcttaacagaagctggcgaaaatgcttgggtgatcggtaagattgaagcattaggtagtggtacagagcaggttgaaatcttgtaatttctcccaccttattcgccccccatccgcccttcgggccccttcccccgcaagcgggggaagaattggaggggagggggaagtgttgtagagcggtgttatgagaaaatttttcccccatttatgggggaagtccctgagcgttagcgaaggggatgggggctgagggtataattgaatttaggtaaaaaaagtgcggttgaggtttgatctgcaccttaattagttggttgtttagtccaactttgggggtgcagatcagtttcaaccgcacttttttattcggtgaagattgacatgaggttgtcatgtcaatctttttttggaggattagatgactaagatgccattttcaatccaaacttgaactttttggtctccgttaatagtgtaaacgtcataggtacgtccattttctgtgactgcactagaagacttattccagcttgcaccagatgcagatgcgtctccccattggcttgagttggtattagtacccgtcaaccaatcattattgttgttacctaagtcaactttgactttgtcgccgttattcacattcaatcccttgtagattgtcaccggcccttctaagcctgagtttttcaaatctccatatctaatgccgataactgcgccattatccattaactctatgcgctcgaagcctttcactttgtctgtggttgctcttgcgcctcccactatgcggtataagtcaatgcctgtgcccccgtcaatcaacgagcctgcgcctatgccttttgagtcttggcggaaggtgtcgttgcctgagcctaggttgattcttgagccttcaccaatttcggtattccatgcgatggttccgtttcctgcaaaggttcgaccttgctcgtttttactgtagtttttgatttctacaatgtcgtctcctgagcccatgtctaaggttgagctttggaaacggtttgcgatgaagatgtcattgcctgcgtttaattggatgttagcgcctttctcaaataatgctcctctgacgtaatcactatctttcccacctatgattttcgaggcttctacgctacctcttgcttgcattgggctgttgaagtagtgacccggtttatatgcgtaggcgccatttggtgccactataaagcggttgtttccgtctcctaggttgatgattgagttgatgaccggactccagttttggtatgtgataccttctactatgatggtgtcatcgccattacccatgttgatggttgcattttcgatgcgtccgccgctgttttgtcctccgtggttgatttggttgttgagtttttcccaagtttcatttccaccgattgaactccagttgctcgcaccgtctgcacctatcgcaaatacttcaatttcgcccgttttcttgttgcggaattcgtagaagtattcgttatcggtacctaccatgagtaagtcgtctccgtctcccatgttgacgctgatgacgtttgtgcctggttgacgttcgctcttatatcttgttcctaggtcgttacctactattaaggtatcgttcccttgttggaagttgaagttgagcttgtagtttttacctgattggtcgttgatgatacctaggctttcatgcacgtagacagtatcattgctgttaccccaagtatattttgcaccttgaccatcttttgatacagaagttggcttgctgttgccgtattttccttcttgtacctgttggagaccccaagacgagttgttaccccagtcttggtagacgtcaatttggttatgccatggtataccaaagatacctgttccttctgcgtaacccacacgtcctgtcggtgttccattatcatttcctacgacatttgtgtattccactttgtctgtcgtggtggtgacgtccgcactttgggtgattctgtcttcgttgttatacgattctatcttcacttggcttctgtctttcactgcgtttggtgatagggtgactttgcctgttgaggtatcaagctgcggtttaagattttgacttattccgttgtacacgctattacttgattcagatagtttccactgaccattagtccctttctcgtaagttaactctttcttctggttgctttcatcatagtaagtcaacttgaacttgttggtgttctccttcggtgtcactattgcaccgcctcggttaacactgtcaatctctgccgttggtttcactggttgtggttcaacctcagctttaacgtttgcctgtctacgggctgtcgtaccgtcaggagctaatgctgagatataaacttcactaccatctttaaccgcacttggcgcaaaagtgacttttcctgttgaagtatcaagtttaattggaccattgccgccattggtatctacattaataccattcatttgcgaatttttagattgatccaattgccaactgctaccctcatacttaaaccaaattgacttattcgtgccatcaggttgctgataatccacacggaagtgtttagtttttggttgtcctgagttttcacttcttggtgaaacaatgactccgcctttgttctgattatccacagttgctgttggagtgtcatattcctcttttggtgtcggtgtagttggagctgttgtgccaccaccagtacgggttcaacttcgccaagcacaccaactacaggaggagattctagtggtacaagtagcggaacccaaactggtgccgacacaagccaaccgcaacaaccgcctgcaccgcagaagccgaaatatgaaactatcggcaagccaacggcagagcaagattcacaaaatctaggtggtgtgaaagttaaacctgcaggaactgacggggatgaaaccaaagcatcccgagtggattacaaagatgcggcaacagggatgaatagagtgatttggttcaagaaaaatgctcaaggtcaatgggagttagattcttctaaagccaatgagcataatggggttcaagtatcgacaaatggaactggtgatatccgtcttaaccaaactaacggcgaagtaacctttgcaccaaaagtgctaaaagatggaactaaagtcactattacagcattcgatagtcaagagcgagctcgtgataatgctactgcagatgcagtcaaagaaccgcaaccgactacgccggatgcgcaaattgacaaacaaaatgcaggtggtgcttgggttcaaccaaaaggtaacactctgaaatttgtgttaacttacaaaaatgagcaaggtcagaaccagctcttggagtaccaaaataaaggcaccaaagacagcccgaattggcaattggtttctgttaataaccaaactatcagccaagcaccaaatggcgtgactgtacagtcaagtacaggtaaagtcaccattgccccatcagcagtgaaaggaaatagtgctgtgacaattgactcttataacaatgagggtattaaaactcatggaaatgagacagtaaccattgcagataagatcgattaccaagatgcacttaataagctaaatcaaattagcaatgacctaggtacttggtataatgaaagacgttggaatgtattcgccagtacaaatcgttatgataatggctggctaaaatatagacttggagaggataatagcgactcttgggcagcacagttatggcgtagaggagaaagggtggtaactccaaaccactttataaaaatgcgattgctggcgatgcgcgtggtagagaatgggtatgtggtaatactgctgatgttgccgttatccgttcatctctaggctacatgaatggagactctggtgatattgaccaaatgaagctcagcttcaaagacggtaacgatatgctactcatcggtaatgatatgggaaccggttacgttaattattctggtggtcaaccactacgtaaaattaaagtggatatgggcgcgggtaatgacgtattacttgtaggtcaagataacgaacactaccatgtgattcaacataaagcatcaggtacctttgatattgttcacagaagcactaatattggcaacgatttcgttcgtatcgataagatgaataatgacgcttggtatggtggccaaatgcgtaatgtagaagtgcatatgggcgatggcaatgatgcaattctattgaaaggtgttgcaaatgctggtgcagacacctacgcatctgccgataacattgtttatctaggtaacggcgataaccgttttattgttgctgatggtgatggagaggcttatagcgtacgtagtaccaatatctatggtggaaatggtgatgaccttattataggtccaacctttgaaaaaggcaccaatatcatgttgggtagcggacgtgataaattcatcacgaagagacttggagatgctcatatccaaatgggagatgatagcgactatgtagaagtgaaaacaagtatctacgcaggagcaaaagtcaatctgggtagtggtcacgatatcttcgtacaaggtgtatggaaaagcgaatcagcaacctccatcgatggtggcagcggtatcgaccattatatcgtaaatggtgctacgggttttaactacgcccaagcatcgaccgctaacattaagggctttgagcgtatagaacttcgtaatagaagcgtctttaacgttcgcatcaaggaccttgtttctgatagtggtttagaaggtccagttaaaatctactatagtaataaatattctactaaagttgatttaggggcaattgatgacgattatacgcaaattagctcacgtggaagcgaaggactgaaagacccaagtcttggtgatagcaactctgtatggatgaaatctggctctgttgtggacaatattatgggtaaaatattacctttgatgtttactaccatagctcagaaagcagttctgcgtataaacatgaggtttggattcaacaaggtattatcgtaatctaatatcttttgtctaaccatctagctttgccactcacttagcacatgtaaatgtgctaagtgtctcaaaatagcatgctaaacaaaataaaagcggtcagtttgcaagccttttttacatatctcgttatttaagaaacagttaatggataaagatctaattttgccattaacacctgatccagatcttcttctggattttctgtcgtgagcaatttatccccatagaaaatcgaatttgccccagccataaaacataaggcttgcatcgcttctggcatattgccacgtcctgcggataaacgaacgtagctttttggcatcgtaattcgagcaactgcaatggttctaacaaactctgtccaatccaaatcttcagcatcagctaatggcgtaccttctactttgactaattgattgatcggtacactttcaggttgtggatcaaggttggcaaggcttgcgattaagcctgctcgttctgggcgagtttcattcattcccacaataccgccacagcaaacttttaaaccagcattacgcactttgccgagtgtgtccattcgatcatcgtgagtgcgtgtatggataattttgtgatagctgtcaggatcggtatcgagattatggttgtaataatctaatccagcttctttcagatcttctgccataccttcttccaacataccaaaagtaccgcaggtttctaaaccgagatcttttaccgcagaaataattttcgtgaccacttcaatatcttttggcttaggtccacgccacgcagcgcccatacagaaacggcttgctccacgagcttttgcaatgcgtgccttttcgagaatttcttctacatctaacattgtttgacgctcaagccctgtattatagcgggcagattgtgggcaatattcgcaatcttcaggacagccacctgttttaatcgaaagtaaggtagaaagttggatctcttgtggattaaagttttcacggtgaacttgtgctgctttaaataccagttccataaatggcattgcaaagagttcttccacttggcattttcgccaatattgtgcggtagggtgtggggtgagttcacttttagcttttaggcgaaggttgaagatggtcatttgttctccgaaaataattcctttaacttctttccccgtttacgggggaagttgcccgaagggcggaagggggaagcgtttaaattttacgatatttcgtatgctgtttcacggctttacggatttgtcgagtactggtacgacgacgggcttttgttacatcaaccttagtttccgtttcaggctttaagccaaccaattcacgcaagtagttcacttgttctaatcccatctcttcccagccaccacgaggtaaacttttttcaagtttgatattgccgtaacgaatacgaatcaaacgactcacttgaatcccttgtgattcccataaacgacgaacttcacggttacgtccttcggttaaggtgacatcaaaccactggttaatccctgtgccgccaactgctttaatctgcttgaaattagcagggccgtcttccaactgcacacctttgcgtaaacgttgtatcattgcgtcattcacttcgccaaatacacgcacagaatattcacgctcaacctctctgcttgggtgcattaaacggttcgctaattcgccatcagtggtaaatagtagcaagcctgaagtgttaatatccaaacgccccaccgcaatccaacgagagcctgttaaacgtggtaagcggtcgaataccgttgctcttccttcaggatcagaacgcgtacagagttcgccttcaggtttgtagtacatcaacactcggcagatctctttttgagttggaattaggttaactaaattgccgtcgatacggattttggtgctcgagctaacctgtacacgatcacctagtgtcgcaattttaccatctacactcactcgccctgccgcaatcacttcttcaatttcacggcgagagccttgtcctgcacgagctagaattttttgtagtttttcaccgacgattttgtcgtttgctttattttccgtttcaatggaagcggttggtttcggcgatttttttacaagtggtttacgattttgggtttcttggcgtgtattacgctgagtcggtttttgcaacgtttttgcagaatctgaccgcttggttgcagttggtttacgaaatgtcgtcatttaagttccttatttgtcgctttcacaagcgtcggggtgttatttactatacttcccccgcttgagggggaagatgcccgaagggcggaaggggggagtataatccctctccctccaaaaatccttcggattttctccaccctctcccgcaagcgggagagggatattatgcttcaaaaggtgtcggatcgcccgaacccactcgaataatttcagggctatcttgagttaaatcgatcactgttgtcggtgattgccctaagtaaccaccgtgaataattaaatcaacgtgatgttctaaatgctctcgaatttcatcaggatccgattgggtaattgcttcatttggtaatattaatgaacacgaaagaatcggctcacccaaggcagaaatcagagccaaagcaattacattattcggcacacgaataccaatcgtcttacgtttagtcattaaacgacggggtacatctttagttgcaggcagaataaaggtataaggatttggcacattatttttaatcaagcggtaagattgatttgtcactagtgcataagtcgaaagctctgataaatcgctacatacaagcgtaaagttgtgattttcaggcaaacgacggattgccacaattctgttcattgcgtgcttatcgccaatcgcacaacctaaggcgtaaccagaatctgtcggataaacaatcacaccaccatttttgatgatttccactgcttgattaattaagcgttgttgtggattttcggggtgaatatagaaaaattggctcatactcttcctttaggttgtcaaaactggcgagattatacgcttttttagagaataagcggtaagattttatcaaatttctgatgattacaatgcaaaaatgtgggagtcagattgctaacaaactatatattaaatagatttaatattgtagggtgggttttaacccaccaataaaatcaatatgttacgtttatatggtgggtcaagacccaccctacaagctactttgtcaataatctggagtgcattttgcgcttccgtgtttttgtaaaatatattttagcggtaatgaatttttaacaatttgaatgtgatcacagtttattttgagtgactcttataaaatctgaacgttatttcatataggaggcaattatggctgactcgcgttatgcttcgttaaaaaaaactgactaaatatcctctagcattagccagaaaacgtagggtgcttttctttctattctcgcttgtttttactttttttatggcacatcttctttcagatccattatttaccccaactcaaagaaatgtgatgtttttactcttttttgcgatttgtttatgggtaactgaagctattccgccgttttcagtaggtattttaatcatcggttttctcgtgttaattatgggaaggcacgatgcacaaaatgcaatgaaatatctacaaacctggtcggatagtgttatttggctctttctaggtggttttttccttgcggaagcaatgaaaaaaaacagcgttagatacgttattgttgaaacatttattacctaaatttggtacagaccctcgttatgtactttggggattaatgttgattactgcactaatgtcaatgtttatgagcaatacagctacaacagcgatgatgattgcgacgattagtcctatttttgcgaccctagacaaaaaagctaatctatctagagcattactactaggcattccagccgctgcttccattggtggaatgggaactatcattggctctccacctaatgctattgcatttagtacagggctaattcaacaatccgaatttagattagggggaatagttattggtttattaggtcctgctttgagcattatatggggctggtttattattgagttgctttactaatcaatagaaaaaaactaaaaaggcagtcgctaaaataggaatgataacttagtgactgcatattttatttctgatgactaatttttcacagtatctagaataatgttttgtaattgctgcagcccatttaaccttgtacttgtcaaatggcgagttatctgcaaatcatcaaaaagcggttgaatttcaaaggattgcaatgcttcagctgatttttccgtaacaaaagcaatcaacaccactaacaatccttgcattaaacgagcgtcgctataaccttgtacttgacgtggctcaagctgaaaattaaaccataaacggctttcacaaccgtgaatttcttgccactgttcaagctgttgttcggttggtttgggtaattgacggcttagttgaattaacaagcggtatctttcttcccaagatttgcaaagggcaaactgggcattgatttcatcaaatgtcataaaatccctatccaagtatcggtaataaaagagctatatcatactgcgattttttgttaaaatcccctgatttttaccgatttgtaatgaggaacacaaaatggctgtaatccctatggtcgttgagcaaagctcaaaaggcgaacgtgcctatgatatttattcccgtctgttgaaagaacgtattattttcttaaatggcggtgttgaagatgaaatggcgaaattaattattgctcaaatgctctttttagaagcagaagatcctgaaaaagatatttatctttatattaattccccaggtggtgtagtcacggcaggtttagcgatttacgatacgatgaactttattaaacccgatgtatctacgttgtgtatggggcaagcctgttcaatgggggcatttttattatctgctggggcaaaaggtaagcgttttgcattacctaactctcgtgtgatgatccaccaacctttaggcggttatcgtgggcaagcgacggatattcaaattcacgcacaagaaattttaaaactgaaagagatgctgacacgcaaaatggcagaacattgttcacagccttttgagaaggtggctcaagatacggaacgtgataattttatgtctgcggaagaagcgaaagcctacggtttaattgatgacgttgtaacaaagagatagtgaataatggcaaattttgagaaagaaccacattgtagtttttgcgggaagcgtcgtaatgaagtcgatgcattaattgaaggtacagaagggcatatttgtaacgaatgtattgatgagtcttatgcgttaattaatggaactgatgagctattgattgatgcaaatgaggctgagagccaagatgtgttaggtaatgtgcctactccacatgaaattcacgcacatttagatgattatgtgatcgggcaagaacacgctaaaaaggtgttgtcggttgcggtttataaccactacaaacgcttacgcaatgcactttctgacaataaagagagtgaaggcgttgagttgggtaaaagtaacattttgcttatcggcccgacaggaagtggtaaaacattgttagcagaaaccttggcacgccgtttaaatgtgccttttgctgtggctgatgcaacaacgctgacgcaagcaggctatgtgggtgaagatgttgaaaatgtgatccaaaaattgctgatgaagtgtgattttgataaagatcaggctgaacgtggcattatttttattgatgaaatcgacaaaattacccgtaaatcagaaaatccatcattgacccgtgatgtatccggtgaaggggttcagcaagcgttgctgaaattgattgaaggcactattgcgaatatcaatccacagggtggacgcaaacacccgaaacaagaaacaattccagtcgatacgtctaaaattctctttatctgcggtggtgcatttgctgggctagataaaattgtcgaagctcgaacaaatacacaaggcggaattggctttaaagcggaattgaagaaagataaagatcgtcaggcactcactgaattattcaaacaagttgagcctgaagatttggtaaaatttggtttaattcccgagttaatcgggcgtttgcctgtgatcacaccgcttgaagaacttgatgaaaaagcacttattaacattttgacagagccgaaaaatgcgattatcaagcagtatcaagccttattcaaaatggaaggtgtggagttaaaattcaccaaagatgctttagtggcgattgctcaaaaagcgatttctcgcaaaacaggggcaagggggctacgttctatcgtggaaaacttgttactcgacacgatgtatgatttaccatcattgaaagcaagtaaagtgacagtgagtaaaaactgtgttgagaaaggtgaaaagccgaaggtggagtaacttaattgatattctccccgtcctaagggcgggaatttttactagaaacttttccactactgaatcaagttaactaatttggtataaccgaacacaaaatttggtaataaacttctccacatttacctaagtcattcacattcacacattcattcactttatgaatggtttggtttatggggccaaactcaaccacttctgcacccattaaggcgataaaacgcccgtctgatgtgccaccgccagtgtctaatttaggtgtaatttgtgttacgttttcgaccgcttgtatcgtggcttgaaccagttttccgttgtctgctaaaaacggttttcccgacaaattccattcaattcgatgctttaaaccgtattttcgcaacatttcggcaactttggttttgatgatttcatcatttacttcggtgcaataacgtaaattgaactgcacataaagctcgcctgggatcacgttattactgcccgtgccagctttgatattggcaatttgcaggcttgtcggtgggaaaaattcgttgccgttatcccattggtaagcggtcagttcacttaaaaacggcagagctgtatgaacggggttttcagctaaatggggataggcaacgtgtccttgaatgccttcaatataaagattggcggtaattgagccacggcgaccgtttttcaccacatcgcctagctgtttggtgctggacggctcacccactacgcaatagtggatcggctcttggcgttgcattagggtttccaccactttcaccgtgccgtctttggctgctgcttcttcgtcagaagtgatgagtaaggcaattttgccctgatggttcgggttgtttttcacaaaggtttcacaagcgatcaccattgccgctaaagaacctttcatatccgccgctccacgcccgtaaagcatatcatcaacaatttcagcggaaaacggcggataagtccattggctttcatcgccctcagggacaacgtcagtatgtcctgcaaaggcaaggcaaggttcgccttcgccgtgggttgcccataaatttaaggtgtcgccaaaaggcaaccattccagcttaaatccgaccgcttgtagtcgttcggcaatcagttgttggcagccttcatcattcgggctgatagatttacgttggataagagatcgactaagagagataatttgattttgcattttatttcactgtatttgctaaattattgaaaccttacaacaggtatatgcctatttttctttatgaagaaaattaagaggattcaaattttagcaataatcccccacaaagtcgaaaggctaataaagggaataaaaggtaatcgggcaagtttttgtttggtgaataaaaaatagagggcataaaacactaaaccgaataaggaggcataaagcagtaataaaatcatctcttcaagggtaaacaaaggcgataatgcaataaagagaagaatatcccctaaacctaaactctcttttttgtagattaactgactaagcagtgaaaataagctaaaaaagagaatagtgataaaaagtgaaaaaatatgggagtttagctcaagggaatgataaaaaagcagttgccataatgctaagataaaaataatcgaaacatagcgaatatccgttaaataatataaataatccaataaagataaatatattagacagataagaataaaaataagcggtaagttttcctcgtaaaatatccaaaccgtaataggaaataaaatataaaaaccgtaggataaaaacgtaaatttaggctgtaagctagatttatggataaaatccgtcaaacttaacggcgattggactaataaattataatcctgataagtctgctgattaattcgcattggaaaatgttgcatttctttttgaaaccaataagcaagtaaaatcgacaataaaaataacatcattctatcattgctcccatatcaaaaatcggcaaatataacccgactaaaatagttcctacaataattcccattaacaccattaacatcggctctaataattgggaaagtatatcaatttgataatctaaccgctgttgataaccgtcgctgatttgttgcaacattggcgataattttccgctctgctcgccaatggcaatcatctgtaacatatccgtaggaaagagttttggatctaaactgtcggctaaacgatagccttgttttaaataagttagtgtagttgctagagaaccttgtaataaaatatcatcacttttattggctaaaaaggaatgaagtacagtatctaaacgaatatgtgaagccagcattaaactgctattttgacaaaaaaagataatgcgtgaatactggataatgccttttaaaataggaatatggcttaatataataaactttaggcgtttaataagatctgtttttttatttaaaatatgaattaatagaaaacataacacacataaaataattagcgttaaaatagagtgttgtagaaaatgggataggctaaagagtatttcggtaattagagggagtgattttccttttgaaccataaagttctgcaaattgtggcacaataaaaagcaataataaaatagagagtgtgattgaaatagctaaaataaagacgggataaaagagaatttttttaattttcttggctaatttttccgatttttcacggcgttgtgcaatgttggttaaaattagccctaaattaccgcttgtttctgccattttaattaattggatttcttgtggattaatatattttccctgttttttaaaggcaacggataacgcaaagccggcttcaatcaagcggattgtttcttgttgccaacggtaaaaagtgcgattttggcaggtttcaagcaacatcactaaactctgttttagggggattttagcttgaattaataaggctaactgttgcataaattgattaatttcttccttttttggtgcagtcggcaaggcaaaatgtcggctaatgcttaactggctgtatcctttttgttgcaaccgtttctctagcacttctcggctttcggcaagctgtcgccctgtctgcttttgcccaaagcggttgcgtcctttccattgaaattcataaatgttattcataacctaataccctatccacttcggtttcattggtgagttgttgttcaattttctgtttagcactctctcgtaggctggaaaaatccaagtaagcggtctgtttatcgaatttttttgccgttctgcttaaacattggtaaaccccgatccgccctctatagccttgatagcactcgtcacagcctactccacgacactttttacagagcttacgcacaaggcgttgtgcaatcactaacagtagtgaattttggatttcatactcttgaatacccagttgcaacaagcgttcgaccgcagagagtgcgtcgttggtatgcagggtcgaaaggactaaatgccccgtctggcttgctcgtaacgccattttggcactctcttcatctcgaatttcgcctaacataatgatgtcgggatcttgacgtagaaaggtgcgtaacagctggctaaaatccagttgaatactgcgattaacttgggtttgaattaagccgtcaatctcgatttccaccggatcttcggcggtgagaatatgtttatccatttggttgagatagtttaaggcgctgtaaagggtgatacttttgccactgcccgttggtcctgtcactaaaatcagcccttgcggttgtttcaaggcgttgagtagtgtggtctgctgttgtggattaaagccaagttgcagaaaatcaaaactggttggtttgtttttttgtaggcgcaataccagtttttcgccgtagatcgtcggcaggctagatacccgaaaatcaagggtgtccgccaaggcggtggtaaagctaaattgcccatcttgtggctggcgtaattcactaatatctagcttcgccagcagttttatccgtgaaataagtcggcttgccagttgaatagacaggcttttatacaggtgcaaaacaccgtcaatgcgtaggcgaataatcaatttttgcttgcgtggttcaatatgaatgtcggacgcattttgggctaaacagaatttaaaaagattatcgagcagttgaataatcggatcgtttaggttgagctgttcttgctcctgttcaacaaaagccagctcgctctcttcataaatgggctgttgttcaggcgagagagcgttaagcaagtatttcagttcatcagaagcaatcaccaccggctcaatctgcttatgggtcataaaagcaaagatttcgcaagcggtgagattgttttcatcatcaacggcaagccataatttatgctcagtttcttgcacaggaacggcaaggtaacgcaataaaagctgtttctcctcgcaatttttttgccaacggctaggcgatatatcaaaaatgcgttcggtttgttgttcgcagatagtgtattgggacattgttaatccttggttatataggggtaggaaagtcccaccccatttgtttacggtgtagctttctgcccacaaaaattcgcagggaacaaactaatgtcagccccttgacagcttgttgcccaagtgatgttgttattagcaaatttcggggtcattgtgtagccgtagccatcaatattgcctttacctgccacggtgattacccccgaagcgacggaaatagatttaagatattttgcgtcagggacatcggatttatctgctcgaacgccatttttacctgaactacattccgagatttttttatcccctacgttataaatacaaatttccacatcggatttataagatgcggaagcacttaataactcagagagagctgccttttgggtgtaactggtgtaagacgggattgctattgttgctaaaatggcaatgatggcgatcacgatcattaactcaattaaggtaaaggcttttgcaagcggtcgaattaacctgatttttttcataaattgtccttctaaaatgaatgcgtaggatttacgccctatttactctgccactttttataaaaaatgcgacgagcaacatttattttttcgacgtagatcgaaaaaatcgttttttcttcctgtgcatttacacagtatttttgctaaaatagggcaattttttgatttgagagtgaaatataaaatggcaaaagcaccaaaaaccgcttatgtatgtaatgattgtggcgcggaatatgctcgttggatggggcaatgtaaggcgtgtttagcgtggaacaccattagcgaagttcgactaatttcggcaaaagagagcaaaagtgaccgcttgagtggctatgcaggggaaacgacaggcaaaattcagcgattgtctgacattgatttgcaggaagtgccacgttttagcagtggtttttatgaactagaccgtgtgctggggggcggtattgtacccggcagtgcgattttgatcggcggacaccctggcgcagggaaaagtaccttgctcttgcaggtaatgtgcggtttatcacaaagtgtgccgaccctttatgtgactggagaagagtcgttacaacaggtggcaatgcgagctaaccgtttgggcttgccgactgataatctgaaaatgttatctgaaacttcggtcgaacatatttgtaatcttgccgatcaggaaaaaccaaagctgatggtgattgactctattcaagtgatgcaccttgcggatattcaatcttccccgggtagtgtggctcaggtgcgtgaatgtgcggcatttttgacacgttatgccaaaacacgccaagtggcgattattatggttggtcacgtaacaaaagatggaactttagcaggccctaaagtgttagaacacgccattgacgcttcgttgttattggaaggggaggcggactctcgttatcgtaccttacgcagccagaaaaaccgttttggtgcagtgaacgaactgggtgtatttgcaatgacagagcagggcttaaaagaagtgaagaacccttcggcgatctttttaagccgtagcgaagaacagacttcaggcagctcggtgatggtattgtgggaaggcactcgtccgttgttggtagaaattcaggcattggtcgatcactcaatgcttgccaaccctcgccgtgttgcggtggggctagaacagaaccgcttatcgctgttacttgcggtgctacatcgacacggtggcttgcaaatgtctgatcaagatgtgtttgtgaatgtggtcggtggggtaaaagtcacggaaaccagtgccgacctagctttattgctggcattaatttcgagctttcgcaaccgtcctttaccgcaagatttggtggtctttggcgaagtgggtttagcaggggaaattcgtcctgtgccaagcggacaagagcgaattagtgaagcagcaaaacacggctttaaacgcgcgatcattcctcacggcaacgctccgaaaaaagcaattaagggaatggaagtctttaccgtgaagaaattaagtgatgcgttggatattgtgaatgatctataagcattaggaaaatgataggagctataattaaactcctatatgttctcccattctatacttcagacaatagtgatgctatcaagaactgatagcgttctgcctgcaccgcttgttttaaacgctctgcggttaaaatgctttttaattcggataatgctgtttggaaatcatcatttacaatcacataatcaaattcattgtagtggctcatttcagaaacggcttcactcattcgttttgcaatggtttctgccgaatcttgcccacgaccaattaaacgtttttctaattctgcttttgacggtggcagaatgaaaatggttttgacatttggcacttttgcacgaatttgccttgcaccttgccaatcaatatcaaggaacacatcaatcccttgctcaaggctacgttcaatcattggcaatgatgtaccgtaatagttaccaaaaacttccgcccattctaagaaatgtccttgttcaatcaggcgtttaaattcatcgtgttgcgtgaagtaataatgtacgccgtgttcttcacctggacgtggattgcgtgtggtgtgggaaatggaaagttgtacttgtgaacgaggaagatccgaaagtaacgcattgattaatgatgattttcctgcaccacttggggctgagatgatatataaatttcctaagctcataatttatttagagttgttctcacaatggtcttgaatgtagggacacactgcgtgtgtccgttgttcattcttttaacgaacacgttgcatgtatccattattcattcagcggacacacgcagtgtgtccctacgattattcattcgtttagcgaacacgttgtgtgtgtccgttattcattgatgtaaatgatagagtaaaaaattaaggacgcaaaagcgtccctaacactgaattttatttttttgcgagtggtggaacaaaggtaatacctaaatcccaaggttgctcaatccacgtttcttgtggaatatcaaccacataatcatctactaactctgcgcccattggtttagcaaacacggtgacaaattttgcattcgggtacatttcacgaatagcacgagcggtattccctgtatccactaaatcatcaacaacgataaaaccttcaccaccatttgcaacttgtgcagcgtgtaatacttttaattcaccttgatgatcgtggtcataacttgcgatacacaccgtttcgacgtggcgaatacttaattcacgagccaatactgcagcagggaataaaccaccacgactgacggcaataatgcctttccattgtgatgcaggtaaaagacgttcagctaatttgcgtgcgtgcatatgaaacatatcccacgtcacaacatatttttcatttgtgtatttctcactcataagttcacctaaaaaaagcggtggcgatgccaccgaataaaaaaattgcgaaatgataacccgaaaacaactttcgtgctatcatttcaaggcaaattttacaataaacgtatttatccgaatgaattttgcaaaattttacaggaaactcaccgctatcatctttataggaaaccgatatgtcagaaattcaaacacttaaaccgcatttattatggaaatggtttgatcaaatctgtgccattccacacccctcttatcacgaagaagaaatcgctcagtttattgtgaactgggcaaagcagaaacagctttttgtagaacgtgatgaagctggcaacattttaattcgcaaacctgcgacaaaaggaatggaagatcgtaaaacagtggcattgcaagcacatttagatatggtgccacaagcaaatgaaggaacattgcacgatttcaaaaaagatcctattcaaccttatattgacggcgaatgggtcaaagcaaaaggcacgacacttggggcagataatgggatcggtttagcctcttgtttggcagtgttggacgctgatgatcttgttcaccctgaaattgaagccttgctcacaatgacggaagaagcaggtatggaaggggttttaggcttacgtccaaattggctgaaagcggacattttgattaatacggataccgaagataacggtgaaatttacattggttgtgcaggtggcgaagatgcaacattaaccttgcctgtgaactatgaacaaaatccgtttgataccacgttacagataagtctaaaaggcttaaatggcggacattcaggctgtgacattcatacaacaagagctaatgccattaaactaatggctcgtacattggctgagttaaaagcgcattttgattttcaaatcagtgcaatccgtggtggctctgtgcgtaacgcaattcctcgagaagcggtcgtttccattggatttaatgcaaaagatcaagacaatctcaccacttatttacgtcagtttgaacaagccttacaacgtgagttagcttttgctgaacctaatttacatttcattgtggaaaatgttgccaaaccgtcacagattttcgctaaagagagcagtgcgaaagtcattcaattcctcaacgtactaccaaacggcgtaattcgcaatagcgatgtggtcgaaaatgtggtggaaacttcattgagcattggcattttaactagcgatgagcagggagtaaaagcgaatattttagtgcgttcattaattgaaaacggcaaagccgatgtacgttcacgtttaacttcattagcagaacttgttggtgcaacggcgacattctctggtggctaccctggttgggaacctgacccaacatccgctattacaccacttaccaaagcgatttatgatgaaatactgggctatgaagctcaaattaaagtaattcacgcaggcttagaatgtggcttgattaagaaagtctatccaaacattgacgtggtttccattggcccaacaatccgtaatgctcactcaccagatgagaaagtgcatatcccagccgtacaaatttattgggaattattgacgagaatattggggcaggtgccaaacaagtaaggaggtattttcttcccatccaaaaggatgggaagaagtctacttaattaaagcgttttaaatttaattttttaattaaaaaattaagtactagaccatagagcggtaaaaagagcaacagactgacaaacaatttgaatgcataatcaactgctccaatagtaaaccagtgttccgccatatattcatcactacttttatagaatgctactgcaaagaatacaaaagtatcaatcagactaccgaaaatcgttgagcttgcaggggcaagccaccacgttttgccttgacgcaagcggttaaagacaaaaatatccattaactgacccaccacataacctgcaaaacttgctaatgcaatacggaaaacaaacagattgaactccgccaatgtagcgactccctgaaattgcccctcaaagaaaatcaccgaaatcacatagctaacgattaatgcaggcaacattaccgctaaaataatttttctagcaagtgacgcaccaaatacacgaaccgttaaatccgttgctaaaaagataaacggaaaggtaaatgttccccaagttgttgggatcgatgtttgagtaaaagggattggaatttcaaacgcaatctgtactaaatagttactgattgtgataataaatatgtgaaaaagagaaagtaatagcaacgagcgacgcttctgctcgtcagaaaagtaatcaaatacgttcatattgttcctttttatataagtttggtggtttggggtgagggaacccaagtgaaaaaagagggcgaatgatacgccttaagaagaaaagatcaagtaaatttacgatgatctatttaagaattggaatttttggttcttaataacaagcggtgaaaaactgcaaattttagcaatgatttcaccacttacacagcctatttagtcaagagatccaaagcctcttgatacttcgccaccgttttttcaatcacatcagcaggcacactaggggctggggcctgtttattccaaccactctgctctagccaatcacgaataaactgtttatcaaaagacgggggattacttccttcttgataggtttcaactgaccaaaaacgactagagtcaggggtcaaaacttcgtccatcaatgttaatacgccattttcatctaaaccaaattcaaatttagtatcacaaataatgatccctttagttaaagtataatcttccgcttctttataaagtgctatagctgcatctcgtacttttgccgctagctctaccccaatctgacgttcgcattcagcatagctgatattaatatcgtggtcaccaacttccgctttacttgaaggggtaaaaattggctcaggtaacttgcttgcttcaaccaaaccttcgggcaatgccaaaccgcaaatagtccctgttttttgataatcttttaaaccactacccgtcaaatagccacgcacaatagattcaatttttactggaactaaccgcttacaaacaacagcacgatgttgaatagcttctgcttctgctcgtggtagcacgtcaaaaacagaatctcccgtaaaatggttcggcataatatgggctaatttattgaaccaaaaattagaaatttgcgtcaggatttcccctttacgagggattggatcatctaagatgacatcaaaagcagacaagcggtcggttgcgaccattaacatacgtttatcatcaatttcgtaaagatcacgaactttaccagaatagatttttttaggctgatttgcataacaaagttccaatatctaaacaaagaatagaataattatatcgacttacgcaaacgtttgctatgagaaaaaataaatttttcgatctctgtcgaaaaattaaaagaatccaattgcagcaatcacaaaatttttttactttatgacaactttatatttacaaatggagtacgcaatgtctctcacctatttatttgaacacagtcggctattactcgttattgctagcgccatactcatctttgcttttggaataaccatatctaatagccggaaaagaacgacattatctaggagagctactattgatactccgatattcccaaaaggctttacagatagttccaacttagcaatagttgctaagtccagttaccataaagtcccattaatgaacaaaagtgaacatcgtttattctatcttttattaaattacctaaaatcacacaaccttgattcacattttcttctattttctcaagtcgccatgggggagtttatcaaagcggaacaggatgaagcctatgcaaaaattaatcacaaaagggtcgattttcttatcacagataaacaaagcaatcccattgcagtcatcgaatatcaagggcacgctcattatcaacataatgcagcggaaagagatgcaataaaaagggaggcttgtcgcaaagctaatatcgcatttatagaaatcacgccaaactataatcaagttgaatttaatattatcttaaagatattgcaaagattttccaaatagaaaggaaaaagagtaaataatggaatagaaaaaactttttatctataaaagaagatgggtgatagatgtaggtcttatcatggagcgggaaacgaggctcgaactcgcgaccccgaccttggcaaggtcgtgctctaccaactgagctattcccgcaaatatgatgaataaaaatggtgcccgaggccagacttgaactggcacgcctcgaaaggcgagggattttaaatcccttgcgtctaccgattccgccactcgggcacaacgaaaaaatggagcgggaaacgaggctcgaactcgcgaccccgaccttggcaaggtcgtgctctaccaactgagctattcccgcaaacatgatgaataaaaatggtgcccgaggccagacttgaactggcacgcctcgaaaggcgagggattttaaatcccttgcgtctaccgattccgccactcgggcataacaaaaaaatggagcgggaaacgaggctcgaactcgcgaccccgaccttggcaaggtcgtgctctaccaactgagctattcccgcagcattgcttaacacaacatattcgttgcggcgtattttagagatttttatatgcttgtcaaacacaaatcagcgattttctattgttcgatgattttttaggaaattattgcacactttttcaaatatcctaccttccaatcatttatataaagagaaataataaagtctgaagatagcaaaaatttttccaactacacagaaaacggatagtgaatactcggatgatattcgtagccctcaacttcaaaatccgccaatgttacccaagtttctaaatcttctagggatttaatatcggggttgattttgagtgttggagctttaaatggcgtgcgttttagttgcacatctcgcattaattccagctgatcttcataaatatgcgcattcacaattttatggaatgcttgtcctgcttggtgtcctgtaatttgtgccattaacgcaagaaaagtgtaacattggatcatattccagtttaaaccgagcggaacatcggcagatcgttgggtactgttcaaataaagcgtgccatccagcaatgaaaaatgatgactgtgtaaacacgggcgtaggcagcccatatggaaagcccctgggtgatagaacgtataaatctcaccacgattatcgacaccacgcttcagatcatcgacaatttgacgtaataaatcgacgctaccaccgccaactttcgggaagtttcgcccgaccgcaccataaaccagccccatatcatcttcgcctttgcgatgtgggtttgccagccaagctgcattttcattggcatttgcgtcccacgattttgtgccaagctgacggaaatctgcagcattatcataaccacggatataaccgagtaattccgcaattgccgctttccagaaacttttgcgtgtagtcacaaggggaaatgcaccctttgccacatcataggttaaatcggcgttaatcacggttaaacaacgcttacccgtacgttcattttcaacccacttcccttgttcgacaatacgttggcagagatcaagatattgtttcataattcaaccttaaaatgtttagagtaatccgcaaaataatttgttagaattgtaacacttttttagtacagagagataaggagtaaatgatgaaatctttatacaaacgagttgctgtcatttttacgttgatattggtaacagcttgtagcactaatacaagcggttggaagcgtttacccgagtcccaaatcgatcaaaaatcctatgcgattgcttatggtgcaacagggcaaacttatgcagatcgcgtaaatgaaagctatgatattacatcttttatccgtggggttgatgattggtttaacaagaaagttaagcacccgatagaacaaattcgggcaagcctgttaaatcgaatgttagatcataatgtgtatgcttattatagcggcgtactttatgctgccgagctacaaaataattttaatcgtctaagcccaacctgttggacaatggttcaaacaccaagtattacacagggtatctatgatgcaatgttagatattcaagccaataaagtccgtcacgataaatatatccaagaaggtgcggatcaaattcttcacttatgtgtagaacaaatggaaaatgaagcccagaaaaggaaatagtgaatctattttcactcaatatcattatgtctgacgatttctttattttccccctaaagcgggggaagataaagaaaaaggatgggtggaatatcaaagataaacgctatagtaggagggaatataaactcacctcactaatagcaggtcaaatccgaaggttatctaactgccttaaacccagctttcgcaaaagcctctttcgcttttggtgtcgctaaaaagtctaagaaacgttttgcttcaggcttatcgcttaaggttgctgcaggataaaccaccttgccataactctcttgagggaaaaccgcgacaactttcaccttatcacttactttcgcatcggttgaatacacaatccccaacggtaactcaccacgctcaatataagaaagcaccgcacgcacatcttttgccttagacaaacgaggctcaacatcagcccaaacgcctaaatgttccaacgctttcttcgcatagcgaccaacaggcacattatcatcgcccactgccaaatagctatctccgatcacctttttaaagttaatatccttaatagatgccactttaattttactgtctgcaggcgcaatcaacaccaactcattttcaaccaacgttgtcacattttttgttttggcaggtagcttctcagccacataatccatccatttttgatccgcagacacaaacaaatctgcaggagcatcttgctcaatctgttttgctaaagttgaagacccagcaaaagaaaaggtcaaactatcctctggataagtttttttatactcatcaccaatttgctgcaacacatttgtcatagacgccgccgcaaataccgtaatattttcagcaaacgcagaagttgcacccaaagccaatgctgacgctaaagctaattttacaaacgtttttttcataaatgatccttatgagagtggattaacaatatataaacaattatataacgaattgtaaaataaatacaaagataaaaattacatttccttttaatacaagaaagtagataatttcagcgttctattttgcaaaaaggcaacctatgttaaacaacgaaatcttattaaccatcaaactaaaacaacagctttttgtcgatcccaaacggattaccctactcaaagccattcaagaatgtggctcaataaatcaagcggcaaaaaacgccaacgtcagctacaaaagtgcttgggatcatcttgaggcgatgaacaacatcagccctaaaccacttcttgaacgcaacacaggaggcaaacacggcggcggtactgccctaaccccctatgccgagcggttacttcagctctacgatttacttgaacagacccaagcaaaagcctttgcgatccttcaagatgaaagcatccccctagatagcttactcactgcaacagctaaattctccctacaaagcagtgccagaaaccaattttttggcactgtcacccaattgagagaagaagatgttcactgctacgttgatattcacattgcagaatttccgcaagatctcaccgcttccattacagctcaaagtgcaaaacggctcaaactaacacaagggaaagaggtaatgttaatggtcaaagcgccgtggattgaaattcaccccgaacacccacaacgcccaaacagcctagcagccaaagtcgaagcaatttacgacaaaggggaatataaagaaattgcattaaacgcaaatggaacggaatgttacgcaacggtcaaaaaagctcaaccgctccaagaaaatcaacaggtatggatacatatcgatcctgaacagatagtcttagttactatctaatccctctacgggcacactcttcggtgataaattttttaacatcccactatttttttatggaatttatggcacaatacacgcctttttgaaaaccattattattttaagggatataacaatgaaaaaatttcttgctctatttttagtcggtggtgttgcagcgttggcggttcactattttcaaggtgataaagccacagcaacagaaacggcaaagccgactgaaccgacaactcaaacaaagcaaaatgatgaacttgctctggcaacggtggttgccccttgggaaatcaatagccttgatccgaaccagacaggggtgatttttcaacgtatgaatttagcggaaaccttagtagaagcgaatttacagggggaacttgttgcaggattggcgaccgaatggaacagtaatgaagatgcgaccctttggacctttaaactccgtccgaatgtgattttccacaatgggcaacctttaactgcacaagcggtggcaaacagtctaaatattgcattggcgaaaccgggaatgttgcaaaaagcctttattaaagatattcaagcggtcagcccgacagaaattcaaattgccttaaccaaatcttttgtgccgtttccatcttttttaacacactacaccgcaattattcttgcccctgaaagctataacgacaaaggggaagtgaccaaagtgatcggcacgggggcatttaaagcgactaaaattgaagcaccacaaaaattggaatcggtgcgttttgaacagtattggggtaataaaccgaaactggctcaagcgaactaccttgcaagtagccgtagtgaaacccgaatgctgatggcacaaagcgataaatctgccttagtgtttaaccttgataccgccagtgttgagcgtttgaaaaccgatccgaatttgaacttaaccagtgtgtctattgctcgtactattcagctcaaaatggacgtggcaaaaccattcttcaatgatttagcggtgcgtaaagccttaagtgaagcgattgatcgcaaagcaattgcggaatatgtgttaaaaatcgaaggtggcgaagcggatcaaattctgccgaaagcctttgcggaatggcgaattgatacgacaacagcaaaacctgatcttgcaaaaatcaaagcagatctaaccgctcgtggttatgaatttaatagcgaaggcaagctaactaaagacggtaagccgtttagttttaccctacgcacattctccgatcgccctgaattaccaatgattgcgacaattttgcaagctcaatggaagcagattggcgttgatgtgaatgtgtctgtcggtaacttcagtgaaatccctgctggacaccaagacggcagtttagagatggcactttatgctttgaactatggcaaaaccttagatccttttggtgtgatcgtgcaggattatgcgaaaacaggaagcgattggggggtgatgaattggcaaaatgcgacattagacaacgctttaactcagcttgaaacagaacgtgatctgcaaaaagcgaaggcgttaaaacagactgtgagccaaattatccacgatgaactgccgattattcctgtggtgtactatcagcaaaatgtggtggcacataaagacgtgaaaaatgtgactttagatccttttgaaagacggttctttttggagatgttgagtaaataaaatgtagggacacactgcgtgtgtccgcttaaaaagccacaattagcggacacacgcagtgtgtccctacagcagattttaaggatttatccccgtgctttctattttattcagacgactatcccagatccttttggtgatttggtcggtcgggactttgacttttattttaactcggcaattgtcgggcgatatggcatatcgtattgcggcaagtcgctacggttacgatcaaaccgatgccgccgccgcagaaatggtacgagcagaactcgggttggatcaaccttggtggcaaacctacggcagttggttagcggatttagtgcagtttaacttaggtaaatccttagtcacaggcgacagcgtttggcacgaaattgaacatcaattcgggcatacctttagtctagcggtggtagcgttactgttagccttgctcattggtcccatcttaggcgtattatcagctcgtaaaccgaacggcgtatttgaccgcttgaccttagtcttaagcagtttatttcgtgccgtgcctgcttttatcattgcgattgggttgattacgcttttttccgttcagttgaaatggttaccagcaggcggatacggcacggcattgcattttgtcttgccagcactcaccttagcgataggtttaagtgccgtttcggtgcgtgtgacacgtcaagcaatggtgcaggtgatgcaatccgactactatcaatttgcacagctaaaaggcttgagccgttggcagacctttgtgcgacatgggatcccgaatattgccgtgccagtgattgcttatcatagcgtgcaactggtttacctgattgaaggggtggtgattgtcgaaagcctttttgcttggccgggaagcggacacgctttagttcacgccatcattgcacgagatgtgccgatgatacaaggcacggcattagtgatggggggattatttgtggtactcaatatgcttgccgatctgcttaatgtgtggattgatccgcgtattcgtgaagggggaacagtatgaaattaaccgttggacaacgttgcggagctttgttattactactgctactcaccactgcatttttacagccttatttctacccgatggatattggttttcaagatctcagcaatatgttggcaagtcctgatgcagaaagctggtttggcaccgatcatttagggcgagatatgtttgcccgtcttgcctccgccattcgcctttcattcggtttatcgctatttagtgttgcttgtgcattggtggcaggcttgttattcggcattctggcaggattatttggcggttggttagatcgcttgtttagctttatttgtgatttagtgatggcattaccaggtttattgctgattttgctgtttgcgtcgctttcccctggttcattttggacactctatttaggtattgccttagtgatttgggttgaatttttccgtgtcatcagggcgatcaccagtacccttgcgtccagctcagaactgcaatcttctcgtttgatgggaatgccttggttttattgcattaaacgtcatctgttcccccgtttactgccgatggttgccacattaaccgcattttcaatcggtaatgcgattttagcccttgcaacactcggatttgtcagtgtgggattgcgaccgcctacggctgaattagggctgatgatgacagagctgttcccctatcactatcaagccccattgattttcctacaacctgtaattgctgtgttcctattggtatttagcttgcagttgttggcggggaaggtgaagtaaatttgaacattaactatcgtgcatatttccttccttatcaaaatacttcccccatttatgggggaagtccccaagcgacagcgagggggatgggggaaaaggggaataaagctaaatgtaaatagcccccatccgcccttcgggcaccttcccccacaagtgggggaagaatcaaacgtagcatagtacgaaggttaatgtaaaatccattgaaatatagtagagaaaacaccgtgtcattactcaaaataaccaacgtcactgttcaaacactcgatggcattgagctggtcgagccgatcagtttttgtcttgaacgtggcaaaaatatcactatcttaggcgaaacaggctcaggaaaaagtctgttaattcaagcaattatgggagcgttaccgcaaggattaatcgcaagcggtgagattgtagtggaaaattgcaaaatagacgggcaatcagaccgcttacaatctctttggggcaaaaccttagtgatgttgccccaagagcctcgccgttcattaaatccactaatgcgaattagccgacaactgtgggagagctttcgctttgtggcaggtttaagccagaaaaatgcggaaaaggcgagcgagatttctttaacccagctggggttatctcaggctcaacaacgctatccacaccaactttcaggtggtatggcacaacgagcttcttttgcaatcgccacggcatcagggggaaaaattctgcttgccgatgaacctaccaaaggacttgatccgaatagcaaagcagaagtgatcaacttactgaaacaagcctatgaaacaggtggaggcttgctgacgatcactcacgatattgaagtggcaaccgctctcggtggctacatttttgtgatgaaaaaaggcaaattgattgaacaaggcaaagcagaacaactgctgaaccaagcgcaagatccttatactcaagccttaatcggtgcagatccgcaacattggcaacctttagccgatttgcaacattctaagccaaaaacaccgcttgtatcggtcaaaaatttaacggttgcacggggaacaagaacgctgttcaaacagctttcctttgatttacaccaaggagaaattttaggcattgtcggacacagtggcataggcaaaagcacccttgctgatgtgctttgcgggctactcaaaccgcaatcgggcgaagtgatttggcatagccacagccataaaaaacatcaagtgctgaaattgtatcaagatccgcccgaagcctttgcaccgaatgtgagcttgcaacaactattggacgatgtgatcgagcatcatcatctcgaccgttcacaaattccagctctattagcacagcttgcattgtcgcctgacattctgcaacgcaacgccgataacgtatcgggtggcgagttgcaacgggttgcaattttacgagccttgctacttgaaccagtgctactatttgccgatgaagtgacttctcgcttagatccgatcactcaacaagaaacgatcaaattgctgattgagcaatgccgagcgagaaattgcggattaattatcgtcagccacgatccgtttttgattgaacgaagttgtgataaggtgattgatcttgaaaattatctttaattaataaaaaagcagaaagggacatttacagaatgtaatattcaaataactcagaaatatgctcattcaaactatttacaccagcgatattctcgccttgccaagccatttgcaatatctctggggacagtaatcgttcatattgttccgaaatagggaaatagctcatatgccatggttctagaccaataaacttattattagcttccataaaagggaaataaaaaccaaaacgttcggcattgactaataaccaattcgttaaatgttgaaaatagcctcctgtctgatattcccacggttccaacatgagcttttttccttcaggaagtaaagtaggatcaaaaatatcaatttctgttccccaatggtgacggctagcccctggcactgcggaccaacgcaggatagcttgacatttgtcccaatcacctaagccagttaatatgatagctttaccatgatcatcatgaactttattttcaccattgaattttgtattccaaatccatttttgtcgttcaaaatcccgataagtacttgcaggttgtaaattaaaacctgctttcagtgcggcatcttgtaaatgcaaaaatgcttttactacttcagattgtaatgcatgctgatcagataatttatttggtaaggcaaccaaatgctgtctgctctttcctgtaagaagagaaggtaaattttcaaaatttaacatgaattaaaccacttcaaaaaaacatgggaaaccgtattatagcaaaagaaaatacaataaataaaacaccacatctctaccaatatcccttataaaacaatgcattctgcaccaccttcatataatgagggttatgtgaagatcgaattcccagcgacaacaggggcaaacccaattgttgaaggggataaagtgaccatcaactacaccccagaacttgaaaatggaacagcgggtacaccgacgacattgacttacacctatactggcggaaaatgggttcaagatgaaaaagattcacttaaacttgagccaaccaatgaaagcggtaaatgggtagtgaaactcccagaagacaaagtagccgacaacaccgaagtcaaagcgcaaactactgatgtatcaggaaaaacatcagcagaaagcaatacgactaaagtcgttgctccgtttgatgaaaaatcagcgcagccaactatcacggtgaaagcagttgacgtagtaagcaatggcgaagcagcgaataatgagcctgaaaaagcgattgtgactgtaaccacaactgcaccgaaaggttcacttgtgaaagtgtacaaagcaggtgaactcaacatcccaattggtgaaggtgtagtgggagacaatggtcaagtggtgattaccatcactgaaaaagccaaagatccaagtagtaaagcacctgaaaacattacatcaatggataaattagttgcaacagtccaagaagtgggtactgatggcacaacaccagtgaaagcaccaagtattccgtctacagctgttcaagtaggaacaccagctatcggtaaacatgatgcgaataatccacaatctggcgggcatgaaggcgatgaaactgcaccaaccacggcgccaacccttgaagcattaacggatgataccaacttaggggctgttaaagtcaaattacctgaagatgccaaagatggcgacagagtgattgtgaaattcacgccagaaagtacgactacgccaccagcaacaccggtggaagtaaccttaactaaaggcgcgaatggctggacttcagataaaccagagctcattgcaaacccagtgaacggcaacgaagtcactattgctaaagacaaagtaaaagacaacacggaagtcaccgctgtcattaaagacttagcggacaatgagaaagctgcatcacctaatgcgagagcgtatccgaatgagcgtactccattagaaaatggcgttgccatagccaaagcaattgacacggacgacgtttcaaatgcaacaccagagaaatttactattacaggtaaatcagaaaaaggtgcggtagttaaagcctatgttactcacaacggtgaaaaagttgagattggttcatttgaagtaacgaatgatgatggtcaatttagtttagaaactaaagacatcaagaaagataatgccttaaaagcgaaactagcaggcttcacattcaacactgaaaatggtcaagcaacccaaatcactgttgaagcgactaaagaaggcaaagcgccgagccatgctcaaactgttaacgcaaaagcagcagagaaaggacaagctgaccagcatgaggaaaaaacagctccagcgaacccaaccattaccccatacatggaaggctttggtggtgcgaaaattacacttccaacaccacaatctggagaattattggaagtaaaagttacagtaacaccaaaagctgaaaatggtcaggatacacaaccagcgaaagaagtaactttaacttacaacggtacaacttggtcattgccaaataacgatagcagcaatcttggtcttacactcaaaaaagacggagataaaaacgttgttattctaagtggcgataaagtgccatatggtggaacaatagctgctaccacaacagactttgcgggtaacaaaccagaagcagtaacacaaaatctgaacaaaggtccaacagacgaaacagctaaagagccagattacagcaaagaccgcacagacgtgccgacaatcaaaactggaagaaccgaaggaactggtactaatagcgaccaaccaaacgcaggcgacattgtggcgaaaccaggcggcgataatgacagaatggttgtgaagtatgtagatgatcaaggtcagccgaaagaaatagctgtgaagaaagatcttgagcaaggtaagtgggtattagacgatacgacaccagcagacaaaaaacctgctagcaccgacgactatatcatcaaagacgacggtactgtgattgtcaaaggttcaaaagtgaaggatggctcagaagcagaagcggtgggttataagactgtgggaagtgaatcagtagcatcaaacaaaccttatgaaactagtgatacaacagaaaacaacactagattgacaaccgttcaggaagccaagattaaggcgttggtagatgatactacaccgaaagaagctgatgcgcctcatttggtgaaaggtaaggacaatacctatcaacaaggtactgcaattattgaaccgcaaggggataatgagaaagttgttgtgtccttcaaaggctacaccatgactccgacagcgatgccaggagagacaaccagcaataatcagccaatcccaacagtgaaacctcagaatggtacatcatcggtcagtgaagatgtagatatggtgctagtggctcaaaaagttaatggcgtttgggaactctttgctgcaaccaaagcagattatgagaagttacaacaagcacaaacaacaccaaccgacaatggcgaaaaccctagcaatacacagggtgttggacttgtttctgctaaagatgctggtattgcaactattgatccgaatacaggcaagattacccttaacgcaaatgcggttaaggatggatcctctgtgacagctaaaggctataatgcgttaggattgccgacagaaggtaaagatgcggttgaaaaaacacaaggggtaaatggtcaaccagatcaagtcacctctaatacatcaattaccgtaggcagcgatctccgtcaagatcaagacgttgttgcagataaaccttctcttgaacagctcagtaatggtgatatggtcgctcgtcctcaaggtgataatactaaattggaagtggcttttgagaagaaaggcagcaataataatgagaaaacgacagttaccattgagcagggagaaaaagatatttccttcgcttcagaagatggtcaaacccaaacagctaaggttaaagtctggaaattcagtgagaaccaacaaaatcttactgaggataacgatggtgatccaaataccatgcttatcaatggcgtgaaagtcaaactgagcccagaaacaggcgaattaacccttgataaatcaggcttaaaagagaatagcaacattaccgccgtaggtattgaagcaaaatctaaccgtagtgaaccgcctgcagaacagcaagttaaggcagatccaacgcctacggcagatcctgcaacagtaacgcctgatggcacgatcattcctggtggtgatactaaggagtatggaatcttcaaaaaaccgcttgagggtgaaggtgaagcacaatctattggtaaggttgtgaagggtgaagatggtcaatggacagatcaaggcttaccaaatggaatggcggtagatcctaacacgggtaaagttacagttcctgcggaacaggtaggagagaataacggcatctatgttgaaaccaaggatggcaatggtgcaatatcgggttctggtgaactagtgaaaacgccaaaaacggatacaacaccggatgcaacagataaaccaaccattacacaaggcacagatgaaaatgttggcggcttaatcattaagccagggcaaaccactacaccagcagacacagataatgtccgtcttgaagtgagctatgtgaaagagaaagctgaaaatggtgaagataagccaacaacagatgcttcaactcaaacagcggatggtaaattagttacgacgaaaaatacccaaactggcaaatggtcttttgaaaaattaacgagagaagtggaacaagatggtgctgacggtcagaaagttaaagtaactgagcagtatgatgtcccatctactgtggcagagattaatcctgaaacaggtgaaatcacgttaaaagcctttgaggtgatggataatactcaggttaatgtgactgcgtacaacaataagaatgtaccagctaaaacagatccagcaacagccgccgcaaacccaggtacagttgcagaagcggatcaaccaaaaggtcctgagattattacggtagagccacctccgccatcaccaccagatgattcacaaacgtctgcagatcaattagataccccaaccctgttccaaaatacaaatacaggtgaggtaaaagtcactccgggtactaacgttgactttatcagtttcactgctgcaataaacggacaaactcaaaactttgcctttattaaagatgcgcaaggtcaatgggaaaaatacgtgatgaaagttaatggcggcgatattgataacaatggcgtattaagcggtacagaaactattgagtacgaaccagttgactctaatataggtagccctccgtttactatccaaaatatcaccagtgataaattaaccaatatcactgtaggtagagcaggtgatgagtatttaacagtaacacaagatcaagcagtccaagataatatggatattggtggaaaaggtgcgcatactgttcatgaatttaaagtgaaaaaagcagattcaacagaagctgtaccggaaaaaatgcacgtgttaagtaacggtgaggaattggtagcaccgattattcaggctcaacacgattcaacagcacaaaaatatcgcgttaaagtgatcgcagatccaacaaaattgagtgcgattcaatttaatattgatgcaaatggtaatgacaatgtgttttctctgaaatcaaatggtacaaattggagttattacaattactggactgataatggtaattacaatgatggtccgaataaaactctagttaaacagggagaagctaataacattatttatattgaagacgtaggttcaaacaaaactttccatatcaataatgatctagaaacgagtaacaaagaaaacctggtttacgagattttctacggcgctaaagcaaatgttgatggtaaacgtatggatgacttttatggaagtaagttaacgtatgaagtgatagctgataacagtacagctggagccattacattgaccgatgtaaacatgaggcaaaaccctcaagcgtttactggtccagtacaatcagcaggtggttcaggcggtactaacacgggcggcgacagcggcggaaccccaaactggtggtggcacagctcaaccacaacctacaccgcctgcacaaccaccagagcaagttgatgcaccaactgcccaagtggattctgcaagacaaggtggcgttaaagttaaacctgcagatactaacagcgttgctaaatatcgtgtggactatgtggatgaagcgacgggtcaatcaagagtgatcaatgtgaagaaaacaggtcgcacttgggcatttgagcaagaaagttcaacaggttcgattgataatcagaagatccagcttaatgcaaacactggtgaattaacctttgctccggaagcggtgagagatgtcggaaaagtcatcattaccgcttacgatagtcaaggaaatgctcgtgctcaaaaagatgtggttgcagcagatgaacctatcactgtgaagctaatccgtgatacagcatcagagaatatcggcggagcgaaagcaacactggcaactggtacgaataagttcaagctaactttcactgatgaaggaaacaacattaacgtaagtaaaccaactgctcataacgtggtttacgaaaaagtaaatggcagttggaaagtggtggaagttgatggtcagaaatcctcaactatcacaattaatggtaacaagaatgttgatttgaataatcagcaaaacggctatttaacggtgaatagcagcactggtgaagtgactatcgaccgcaatagcttaaaagacggttctactgttagtatgattccatacagcaaacgtggcacggaatcttctggcaatgccaagactatcaccactgaaaaagataaattagtgaccgcacttgatgatagtagtcagaacttaagtcagttaaggggtacggatcatagatggggtgaagtggctatcaagggcaacggcggctatatagatggattggcacagcttgtacatggtaaacgacatgataaatctgacaccaataacgcgaaagctacggttacaccattgacacaagaggaagataaggcaacggtttcaaacggtaaaggtaaacgactcagttatagtgacaataacgatgtagtgaaaatcggtgagaaggtcatgaataaatggacttgggatccaaccttgaagtttgatttcaaaaatggcgatgatattcttgctgtaggacacgacttaggttatggtgattggggctactctggtctgaaatcagaatatgaacactggcagaaagtagctgatagatatcgtgttcaagttgatatgggcgccggcaatgatattttggctgttggtttccatgatactgattgggatgtgataaaagacagaaataccggtgtaatagatattcataaacgtagtcaaggtattcacggatatgaaaaagtcgagttcctgaactctaacgaatggtacggcggtcaattagctggtgcaaaagtctttatgggtgatggcaatgacaccgttatcttaaaaggaacccctattgatagaaacggacaacatgcatcgaagaatagcattatcgatcttggtgaaggcgataaccgtttagttctcactccgggggaaaccgttggtcgcgcaatgagtagcaccaaagtggtggcgggcaatggcaacgatgtagtgaaaggtgactctttcattgaaaacactgatattcgtcttggcggtggtagcgatgaatttatcgcaagaaaagtggaatacactcttgttgatctcggtcatggcgatgactgggctgaggttaaaggcgacatcggtaatggtgctcagatcttactcggagctggtaacgacgtattcagtatgaaagccggattaagtcctaacaactccagagtagatggcggttcaggtgtggatacgctattgattgagaaaaatggcgctcacattaccaatcataagattaaaggttttgagaatgttctctttacagccaataatacaacgttgggtattagagttgactatttcggatctattgaaggaccaatgaaggtatccaaactcagtaacgttactggtgctaaagttgatttgggtatgaatggtgatatgagatctaatgctcaagattctcaaccagatgatagagcagatggttcatatcgttggactcataagagtacagcagcggaaggggataaaacatacgatgtttatgagtatgttgttgctccgaaacaccaagtttggattgaacaaggtatcatagttctctaatccccaaaaaagattgacatgacatcgttgtgtcaatcttcaccaaagaataaagaggcaaagcaatttgcctcttttttttggaaaaaccaccgcactttggtgaaaaatctattttggacgccaagcttggcgtcgctacaatcactgcgttagttgatttgttggaataattgaaatgtgcgacccattacgttgatttgtttgtgaatttttttatcaccaacagaaaaacattcggagtgtttgtagggacgccacgtgatctgaccccaaaaagtttcaaccgcacttttttttacctaaattcaattataccctcagcccccatccccttcgctaacgctcagggacttcccccataaatgggggaagaattttttcgctcccccactttccaaattcttcccccgcttgtgggggaaggtgcccgaagggcggaaggggggcgaatatgagcgcttttcgattgttctaaaaagatttctcgttaaaactaaatagcgtagaatgatgtcatttatcactacatgccttgataatcatgaatccactaaattcgctacaattagctttaaaccaatctagccttattgaagcctctgctggcacaggcaaaacctatacgatggcaaatttgtatttgcggttgattttaggggttcggtgtccctccccattaacggttgaacaaatcttagttgtcacctttaccaaagccgcgacacaagagctacgagatcgcattcgggaaaaattggtcaatgtaggaaaatggtttcgagatccctcttctaaagaagcgcaagaagcattacaagaaccttttctggcagaactttatcaagaagttcaacctcgtttaaatgaatgtctcttacgcttaaaaattgctgaacgtgaaattgatttagccagcatttttaccattgatagcttctgtcaaaagatgctgtttcagtttgcgtttagctctggcattcgttttgatattgatttattgacgaatgagagcgaactgcttaaccgtttgagtgaagaaacctggcgtgagctattttatccaatgggacttgcggaaaccgttgccgttgctgaagagttaaaaacgccttctgacgcattaatcgcagtgaaaggttatctctatggcgattttccagatttaacggcagaaaaccaatggctgacacaaggcatttcaagctatctcaccgattatcaagccttgttacaagaagctaaacaacattggcttgccgtaggggcggaagcggaaagcctgattgtgactgagatcaataaaagctacaaaaaaggtgaaaagaaatcgctcagccgtcgtgcttatcagatgcgttgggttgaaaattggttgaaagagctgaacgaatgggctacaagcggtagtcattatttcccaacgaatagcttctctcgcttttgtcaggattttatcaatgaaaaagcagaggagggggcagaaccactcccccatgctatttttgcaaaaaatcaagattatctcaccgcttaccaaacacagtttgaaggcaagtcaaaagcgattttgctctatcaattctttagccatttgcaccaaaaactcaccgattataagcaaacccataaagagaaaagttttggcgatatgttgagctttttgctctcagctttgcaatcggaacgtggtacagatttagctcaacaaattagagccttgtacccgtttgcgatgattgatgagttccaagatacgaaccaacagcaatatgaagtgttccgtcgtatttttatggatcaaaataccagcgagcaaggttttattatgatcggcgatccaaagcaatcgatctataaattccgtggcgctgatattttcacctatttaaccgcgaagaatgaggttcaggaacaagcaacccttgatcgcaactggcgatctgtgcctgaagtggtggatagttgtaatcgtctatttcagttcccagaaggaaataatcccccatttttatatcacggcattcctttccaaccagttaaagctaaagaggcttcagatgcattagtgggtgaacaagcgacccgatgcctgttaatcagcacggagtttgatgaacagcttgcggccgctcactgtgcttatcaaattcaacaacagctgaaaaagagtgagcaagggttgctctttgtgcaaaaagaggagggaaatagaccgcttgaagccaaagacattacgatccttgtgcgtagccataaacaagccagtttaattcgtacagaattattaaaacgccatattccatcggtctttttctctgaacgaaacagcgtctatgaaacccaagaagcacaagatttacgctttattctttctgcgtgtttaaacccttaccgtcaatccagtttgctttcagccattggcacatcgctttggggcttaacatcgaccgacatttttaatatcaaacaagatgaaaaagcgtgggataatgtggtggaaaactttgtcggctatcaacaagtttggctacatcaggggattttaccgatgttgcaccaaatttttgtgaaagaaaatattatccaacggatcaatgctttgcctaatgcagaacgtcgcattactgacctgttgcatttagccgaattactacaaggggcaatgccaaatttagagaacgagttcgccttactacgttggtatgaacagcaattagctaatcccgatggctacgccgatgaacaaaaacagcgtttagagagcgaagaaagtttagtcaaagtggtgactatccacggttcaaaaggactggaataccctgtggtttggttgccgtttgtggctaaagcaagccaaccagccaaaagtaaatcaatggcaatctatcaaaatgatgaaggcaaggcttattggagtttcggctcacaatccgacgaaatcaaaaaatatattgataaggcagaatttgcggaagatttgcgattgctctatgttgcggtcacacgagcgaagtatcaactaaacttgatcttgccaggtcaatttgatgacaaatggaatagcctaagttatttgttaagcagtggcgagattggaacaggtggtgtcaccccaagccaaaatacgcaatattatttagcgcagaaaggcattaacgcagagctgattacagttgataatgatgtgcctgaagacgattggcaaccaacactcgtacaacctattgatattgaagccaaatcctttacaggcactattcgcatagttgggcaaattaccagtttcacggcattacaggctcaaaatgaacgtttgcaacataaagggcaaaacataccgcttgtagcctttggtgacgaagctcaagattatgaccgtacagagttcatcttatcggattttcttgaagataacgctcagccatatagtcgctaccaatttccacatagcacgaaagtcggtaatctgttgcataaattctttgagcattgggattttcaacaagcggtggatcaaacacaattacaggcattgtgtgaacaacttgatttagacgaagcgtggcttgaacctttaacaaggtggtttgagcaagttattcaaaccccatttggtgatcaagcggtaagtttagcgcagatttttatccataagcgcttgaacgaatggcaattttatttacgcttatccaataaagaagctttatatcgacttaatcagctactgaaaaaatatagcccgctagcaaaacagttgcctgatttaaccttatataaccttgaaggcttcgtgcgtggttttgtcgattgtattgcccaaattgatggcaaattctatgtgattgactataaatccaattttttaggctacttgccacaagattatcaagctgacaaattagccaaaacaatgggacaattccgctatgatttgcaatatttgctctatacccttgccgttcaccgctacttaagctctcgcctaggtaaaaattataactacgaacaacattttggcggagtggcttacttatttctacggggaatgaacggcgagccaaatagcggcgtttattttgataaaccaagtatggaattgattgaagaaatggataggttgtttgggtaagagatattctctatatcaataaagcccactttgagtgttttgtgggacgaataaaaagaaaaatgatatttattgtttcggattaatgtaattactccctatattcgccccccttccgcccttcgggcaccttcccccgtaaacgggggaagaattggaggggaggggaagtattgtagagcggcattatgagaaaattcttcccccatttatgggggaagtccctgagcgttagcgaaggggatgggggctgagggtataattgaatttaggtaaaaaaaagtgcggttgaaactttttggggtcagatcacgtggcgtccctacaaacactccgaatgtttttctgttggtgataaaaaaattcacaaacaaatcaacgtaatgggtcgcacatttcaattattccaacaaatcaactaacgcagtgattgtagcgacgccaagcttggcgtccaaaatagatttttcaccaaagtgcagtggtttttccaaaaaaacagaggcaaattgctttgcctctgtgggttatggtgaagattgacaaaataacttgccaatctagggattagataactatgatgccattttcaacccaaacttggtgtttcacgtcactgtttatggtgtaaacattatatgttctaccatcttctttaacggtacttccgttcctccaagagccaccctgatcacccaggttttgtgcaggactatccgccaaccaatccgaattattattccccaagtcaaccttgactttatcgccatttttgacttctgtgcctttcataaccttcatcggaagttctaagccagaggcttttaggtcggagtatttaataccgataatcgcaccgttatcaaccaattcaacacgctcaaagccttttatcttatcagtggttgcttttgaaccgccgccgacacgatataagtcaatgccgcttccgccattaatctgaacatcgtaatcaatatgttttgagccttggaagaaggtatcgttgcctgtgcctaggttgatttttgttcctgcaccaatctgagtatcccacaaaattgtgcctaaacctggtaaggtttgacctgtagtcggatctttactgtagtttctgatttctacaaggtcatcgccggcacccatatctaaggttgagctttggaagcggttcacaacaacatggtcattgccatctttgagctggatattcgcaccttgctcaattaatgctgctttgatgaaatcgctgtctctaccacccaaaatggtcgagctcttaatatttccacgagcctgcattggtgagttgaaataatgccctggtttgtaggcgtaagctccatttggtgcaatcaccacacggttattaccatcgcctaagtcgatagttgagcccatgattgccccgaagttttcaccggtaataccctcaacaataatagtatcatcacctctacccatgttgatggtcgcattttctatacgtccaccgccagcttggtttcgatggttgatttgattcgataggcgttcccaagtttgatccatattttgagaactccactgacttgagtttttcgcatctttcgtgaaaatatcaatttcaccggttttcttgttgcgatattcttcaaaatactcattatccgtaccgaccatcagcaagtcatcgccctcgcccatattcagcctaatgatatccttaccatcacgcttatatttcgtaccgaggtcgttaccgactacaagggtatcattgccttgttggaagtcaagggtaagcaggtagtttttccctgactgctcgttttgtttaccgagcgtctcatggattaacaccgtgtcgtttctattactccatttataggtcgctccatcgccatctgggcgtgtagattgaggtcttgagtttccatagccaccctcgcttagctgtttcaagcctgagcttgggctattgccccagtcttggtaaacgtcgtcgttgccttttataccaaatatacccgtccaagagttatagcctaggcgtccggtgatgttttgaaagccagttgttacaccgtcgtagttcaccacatccaaagtcgtcttcacgctagcattgcccttaataaagccttccatgttgtaggactcaattttcacagtgctgttgtctttaactgtatttggagcaagggtaactttgccctcattagtcaaattaacaccctctggagcttgactagactgttgtccatcaacctctttcaacgcccagttattgctctctttagcataaacaagggttttctgttttcctgttttttcatcgtagtaagtgactttgaatttgctggtgttttcacccactttcacaatcgccccgcctcgatttgcactatcgatttgagccgttggtttagtcggttgtggttgtaaaaactcatcgcctgctttacctacaagaatgttggtaatgctatcgctggtaatattgctgacagttagagctccgttgccaatagtctgtacattgtcatagataactttttcgtcaccatccacaatgtcattaccattaccatcgcctaactgcataacatatttttcccaaccattatcatctttaataaaggctatattttgctcgcctccatctttggttgtcaccgtgaagctaataaaatcaacaccagcctctggattgatttgtacttgaccaatacctgtgtttttaaaggttgttggtgtttcatctgctggagttatagttgttgtatcatctataaactctggttgtgccggtggctgagctggggtttctggctcaggttcaaccgtaggcggtttcggttgattatttggatccaccacatccggattgctcggtgctttcgtgctttcatcgttttctttaacaatggtattaccggagctatccgtcgcctccactttaattcctgtgccgtctttcaccgcctcaggttttaaggtgatcttaccggtatcttcatcaatttcagctatttcactcggcacatcgccactaaacgaccacttattcgtattcggatctttcaccgcggtaatggtctcgtagtttttctcgccttcagtaccgcttgtaccatcgctagtgcctgtcgccccctcttcaggtttaacctctttctcatagcgaactgtcaaggtgttattatcaccgcccggtgtcacttccataccgccttgttgctcaccctctgtaataggtttaactgtaggcgtttccgcagcatgttccgaactatctttcttcggcggaactacaggctctgttggagtagatttgttatttttgccatccgttgccactgctacaataccattgccatcgcctacaagggaccaccacttgggaaagtgactttacctgtagctggatcaactttaggagcatctcccgtattggtgcccttaccttgccattcccattgaccattctcttttttcaccaccttaccgatagattcaccgtttggtttatcttccgatgttgtaccattggtcggtttcttaaagaactccatctccttagtatcatcacccggtgtaaaggttgctttatcgccgtcattacctgtggtaatcggatctgcacgatctggcgtcatatcctcttgaacggtatagtcacctgtagtgatcgcgttattctgatcatccttagcatcagctttcaccgttttaccaatctgagttgcatctttcggaattgtcaccgcacctgtagtagtatcgacagttacaccatttggtaaactaatggtttctccgttttcagtggttgtaccgactgtatcgccagttgttgtaccatctgttccagttatagtcgtcccctctttcttcacaacccattttgttgcgtcttgaggatatgcggcagttcctgtttctccctgactcgctggcactttttccaatttaatcgtctgtgtttgaccatttttatcggtataagtcaccgtcatttccttattatcttgacccggttttaccatcacatcacccttattggtttgggtaatttctggcgagtacacggttttgtctttgattccttttgcatctaaaccagcatcaacggtttgtgaaattccctctttacccgttgtcggttgcttcatcgcattaaagcccgtcgcagatacttgagtgttatcctgcaccgcctgaggttttaaggtaatctcaccgcttgtcttatcaatggtcgccacatcttccggttcagacatcagatttttcggtgcattatgttctttaccatcagtacctgtaactttggtgttatagtcctgttccgttgtggtatagagtttccactcaccattttctttcttagcaatcaacaccgcattttcgttttgaggtgtttgagtttgtgcagcatcgccagtcgttgcacctgttactggtgtagaagtaatgactttagtcgtagtctgctgcgttgcaccagcttgaccatcagcaccagttgccgaagttgtcggagtagtttccgtcactgtcttcgcagagccttgttctaaggtgccgttttgacccttagtcactgtcggcgcatcggtttccgtcggagtctcatcatccttatgagtaataatcttcgcgaggtcggttctcgtgcgtttttgaccgttttcatccgtcggaatttgattttcttctaacgtattaccactgctgtctttattatccacataaggctcgcttgaggctttttgttgatcacccacagtcttataacccaccgcttctgcttctgagccatccttcactttctgacctttaacaatcacagtaccgtcgtctttgatgatatagtcaccctcagcaggttttttatcctgttcagccggttgcgttgtatccaatacccacttaccttgctcaagatctttcttcacagcgatttctttcggctgaccttgatcatctacatacttcacaaccattctgtcattatcgccgcctggtttcgctacgatatcgcctgcgtttggttggtcgcctgaaacgccgttaactgcctctgttctgcccgcagtgattgttggcacgtctgtgcgttctggtgaatgagtatccttagctgtttggtctgtaggccctttgttcagttcttgagttgctgcttgctctggtttattacccgcaaagtccgttgtggttgctgagagcgtaccgccaaatggtgctttgtcaccggtaacgatagcaactgttttaccatcaacttgttttaaggtaattaaattagcattatcaccttcgacaacccattgcgagccattgtgagctaatttcactttcttagcttgttcagaagcaccattttcaccttttggcgttaaggtaatttcaacctctaacgcttccccttgagccggtgtcggaagcacaactttcgccccaccaaagccttctacatacggggtaatggttgggttttctggtgctgttgtttcggtgtggtcatctttttcacctttacgagtagctgttgcgttgactgtttgaggtgcgctcggtgctttacccgtgctggttgcttccagagtaattgctgttgcaggactgtttgtgctgaaattgaaatcttttaatttctcttttagctgaccatctcggatattatttgtatcaaaggtaaactcgccgttctcagatgctaccgtagttgaaccaatctcaactttttcattgttgtacattacataagctttaactaccgcatctttttccgctttacccgtgatagtaaatttctctggtgttgcgttagagacggtgtctgtgtcaatcgctttagtcaatgatacatctctcaacagtgtcacttcatcaaaggctgtggttacgtcttgccctgctgtctcattgcccgctaaatcaacaattttcaccttaactggcgagttgtctttcacttgatttgctgggatttcagcactgttgccagttggatttgccacaacgtttgtgttatttgaagtccaattgttatcgctacctttagttaaagttacgatcactttttcttctgaattttcaggcgtaaattctaataccacacgatcgcccacctgtgcatcgctaggtaatgctacagttacagctccacgtttgttgccagtttgttctgccgtaagtgttggagccgttgtcggcggagtattatcgccttcgtgtccacctgaattttccacatcattattgctatgtttaccgacagcaggtgttcctacttgaacagctgtagacggaatacttggtgctttcactggtgttgtgccatcagtacccacttcttggactgttgcaactaatttatccgttgatgtaatgttttcaggtgttttactacttggatctttcgctttttcagtaattgtaatgactgctttgccattttcaccaacaacgccttcaccaattggggtgttgagctcaccttctttgtacactttcacaagtgaacctttcggtgcagttgtggttacagtcacaatcgctttttcaggctcattattcgctgcttcgccattgcttactacgtcaactgctttcaccgtgatagttggctgcgctgatttttcatcaaacggagcaacgactttagtcgtattgctttctgctgatgtttttcctgatacatcagtagtttgtgctttgacctcggtgttgtcggctaatttgtctttaagaatcgttacactgactttgccattttcagtggttgggtgagtttaaatgaatctttttcatcttgaacccagtttccaccagtataggtgtaagtcaatgtcgtcggtgtacccgctgttccatcagtattttctggggtgtagttgatggtcactttatccccttcaacaattgggtttgcccctgttgtcgctgggaattcgatcttcacataaccctcattatatgaaggtggtgcagaatgcattgttttataagggatatttgataggaaaagaactcatttagttgaaaaagtgaagaaaagggagaaaagctaggtggtgtgattgaattgagtgcatttttatcaagagaagggcatttttagccaatgctatcatatgccctagaaatacctacgaattaaaattgctcgccatatttaggcttttcaatatttgtaaaggttttattttgattctctttaatcatttcagaaattttttgcgcagaatctttaatacccatcgcttcaaaagatgtttttagtaagggtaatgcttgatatgttgcctgagtatcgggatataaacgtagcatttcatctactcgattaacaaccgcaacataagcctttctttccatatagaattcggcgatttttagttcatgttcagcgaggcggtttttcaaataaatcatccagttttgagcatctgaggtgtattggctatttggatattgaaaggtaattgtttggaaattaccgtacgcatttcgaatgttctctattgctctagaggccctgttaattccgaagaaatcttgtatccagttatcgcctaaacgtgcgtagtttaatcctgcaaggtagtaaacataatccatgcttgagctgtttggatgagttctcgcaaaacgttctgcaacctctaatgctttgtaatattcacctaatttatagttcgcataaatcaaacttaattgaacttgctcatcataagccccttgatttgagcgtagatcaactgcatctaaatagcgaattgcattgttataatcaccatcttgtaaatatgcttgtcctttgtcataaagttcttgagaaggaataccctcaaattcatcttttttagaacctgaacaaccaacaacaagaagccctgcaaggactaaagaagcaagagaataaaatttacgcataatgatttacctataaaaagtgtctgcaaactgaaagttaatgtacaatgctattcgacctagcattgttcgtaaagttcgtacgaaaatgctcatattctacaataagaaaacataatttggaattttatcattaatgactcaacaaataacattacaaactgaagtaacttcagatttattaggtgcaagattagatcaagcgctcgctcaacttttccccgattattctcgttcacgcattaaagtttggatcgaaagtgatctcgtttcggtcaatggcaagattgtgaataaagctcgtgagaaagtattcggcggtgaattaattgaaattcaagcggaaattgaagaagaaatccgttttgaaccgcaagatattccattaaatatcgtttatgaagatgatgatattttagtgattaacaaacctaaagatttagtggttcaccctggggctggcaatccagatggcacggtgttaaatgctttattacaccattatcctcaaattgcagaagtgcctcgagctgggattgtacatcgtttggataaagataccacaggtttgatggtagtagctaaaactgttcctgctcaaactcacctcgtcactgctttgcaaagacgtgaaattactcgtgaatatgaagccgtagcaagcggtattatgacacaaggaggcaaagttgatgaaccaatggctcgccacccaactaagcgtaccgcaatggctgttcacccaatgggaaaacctgcagtaacacattatcgtattatggaacgtttccgtaattacagccgtttacgcttacgcttagaaactgggcgtactcaccaaattcgtgttcatatggcacatattgcccacccattgttaggcgatcaactatatggcggtcgtcctcgtccacccaaaggggcaagcggtgagtttttagaggttttacgcaattttaaacgtcaagcattacacgcaacaatgcttcgcttgcatcaccctatcactggtgaactgatggaatggcacgctccattacctgatgattttgttgaattaattgaggcattaaaagcggattatttattgcataaagatgaattagattattaaatgagaaaaaaatccccaaacatatgtctggggataaaacgaaaaaagtataaaatacttaaaatttaaccaaggaaatatctatgaaaacagtaaggaatctctctatttatattgaatggcggtgagagggggattcgaacccccgatacagtttcccatatacacgctttccaggcgtgctccttcaaccactcggacatctcaccgaatcaataaaaaatgtgcattaaaatgcacatttgaaagacgtgcgaactatactgatttttcatagtctaatcaagtattttcttcaaaaaataaaataaattgtgaattaatgtccgtgtcctaagcaatttgttgatgatggaacttcttcgcctcgagctttccattctgttggggtgtaaagatgtaaggctaaggcgtgaacgccgttggctaattcttctgcaaggcaggcataaatagcttggtggcgagcaacaggacgtttgttttcaaagagttcactaaccattgtcactttaaaatgtgactctgagcctcgtccagagctatggcgatgactctcgttttcaatataaagtgtcactgggttaaattgtgtttgtaatttttcgacaatagtttgttcaacagacattttttatccttttggtttggaaatttgggtggaataatactatactttgcattaattttaattgagattatcaaggatcctatatgaaatttaataaaaaaacatttttagttgccactacgcttgcaaccgcattattagcaggctgtcaatctcagtcaaatacactgacgttcactacaccagcaccgaccgcaatgtttaatactcataatcaaacagcgttagtgaatgtgagtacacaagatttgcgtacatcggctgaagtagcaagctataccagtgctggcaatgttaatcgtttaagtgctgtgccaacggtgacacagttataccaacaagcaatgcaacaaaatctgaacagcaaaggttttactgtagtttctggtgctggaaatgcgaatgtgattgtgaatattcgtcaattttttgctaatgtggaacaaggaaatgttcgctataaagtaaccgctaatgttggtatagaggttgttgttcaaggtgcgagaggtcattttgcgaaaaactttaatacctcccgttcttatgaaggggcgtttggtgcaaataataatgaaattcataaggtgttaggtcaagcgtatagtgagtctattcaggcaatctataacgataatgaaattagtaacgctattcatcaatttaagtaacaatgtagaagcggtaagattgagataatcttttggagattatccgtattatgtagcaaaaatagtagggaggccaggcttggcgtccattctctaaatttgcaaacaatctataatcaacgggtattcggcgttcattgtataaaaaagcttgtatatttattacataatactgcctgcttacctttaggataaaacctacccacatttcaatagcaataatgagaataccaagaatttaccacccagaagcccttgctggcaaaagccactgtattttgagtgaagatgcctttaaccacgttggacgtgttttgcgtatgggcgagggggctgaacttgttttatttgatggctctaaccatatttttaatgcgatcattgataacgtatccaaaaagcagatcagcgtaaaaatccaaaatagccaactggacgatagagagtcgccgttacctatccatttagggcaagtgatttcccgtggagatcgaatggagtttaccattcaaaaatcggttgaattgggggtaactaccattacaccattatggtcagaacgctgtggtgtaaaattagatggcgagcgtcaagataaaaaaatccagcaatggcaaaaaattgcaatatcggcttgtgaacaatgtggacggaacattattcctgaaattcgcccgataatgaagctgaccgattggtgcaaagaacaagatggaatgctcaaactaaatcttcaccctcgtgctaaatacagtttaaaatcgttactgaatgtaccccaagagggcgtacgtttgttgattggttcggaaggtgggctttcccctgaagagattgcaatgacagaagcggagaattttacggaagttttacttggaaaacgtattttacgcacagaaacggcttcacttgccacgatcacggcattacaaatgctttatggagatctcagctaaatgatgaatttacaaggacaatttttgattgccacgcctgatatgaatgatgactattttgatcgtgcggtgatctacatttgtgaacataatgaacacggggcaatgggcataatgatcaactcaccgacagatctgtccgtgatggaattgctcgccaaaatggattttttaatggcaaatgaacgcaattacaccaaagatcagctcgttctcagtggtggacctgtagggcaagagcgtggctttattttgcatactgcaaccgatcagctctttttacatagttatccgaccgctgataatttaatgcttaccacatcgggagatattttagacacctttgggcgacaagatgcccccgctgattttatcgtctgcttaggctgttgcacttggaaagccgatcagcttgagcaagaaattgcatgcaattactgggtaactgcccctgcgtcccataaaattctttttgaaacaggttatttagatcgttggagcgaagcgaatgcattactgggtatcgaaggtattttagccaaagcagggagagcctaatgagccaaactgtgcttgcctttgattttggaacaaacagtattggctgtgccgttggacaaagtatcacaggcaccgcacagggtttgcctgcttttaaagctcaagatggcataccgaattgggagcagattggcaaagtgattgcacaatggcaaccagatctcttagttgtcggcttaccgcttaatatggacggtacggagcaaccgctcacgcaacgagccaaaaagtttgccaaccgcctaaacgggcgttttaatttgcccgttgaattacaagatgaacgcttaaccaccgtagaagcaaaatcagaaatttttgccagaggcggttttaaagctctcaaaaaaggcaaagtcgatgcgatttccgcttgtttaattttagaaagttggtttgaacagcaatcataaaatatagcagttttgaatctataaactttgatacaacttaaacgcttgcccatcagacatactcgcaaggtagtcgcaaatcacccttgggcgttgctgttcatctgcttgtatccaacgttctgccacagatttaggcagtaagcgggttggatcgcaacttagcatatcaaacagatccattaaaattcgctgacctttatattccacccgttgcgttttgacatcacaaataacatattgatagacaaagtttttaagtacttctaacaccgcttgtgcttccgttggtaatatcgtattaaaacgcagtaatggctcttcaaactctgctgtttctgtccattttacatttgtcacaaaataattgactagcgctccaataacatctttgcgttcgtagcggtgaattgagaacaattttttgctgatgtcaggtaacattttttgaatccaagctgatttacattgagagaaggcttgttccgcattttgccacgattgcggcgtgaccattccgccaacaatcgcatcttctaagtcgtgaaccccataagcaatatcatcagccaattccataatactgcaatctaaggatttataacgggttttgtggggaagcagtggatcttggcttatttcaatttgttgaaataacgctctatctgcgacagaaagcggttcaagcacccattcaaaaaagtgagcgtctgcacggaaaattcccttacttgtttttagatcgtgtaagttgatataacggctatttggaatggcttttggagtttgtggctgagttaaatcaataaaggtaggatatttgatgatacctaacaaggtgcgacgcgtcaggttcattcctgcatttttggtataaggctcaagctgagtgacaatgcgaaaggactgagcatttccttcaaaaccaccaaaatcctgcattttataattcaatgccatttcaccgccgtgtccaaaaggggggtgtccgatgtcgtgggcaaagcatagggattccgtcaaactacgagaaggtaataaagcggtgagatcttcattgaattttgcaaatgttggatcggaacagaccgcttgaaagccttgcctatcttccaccaattttgctcttaagctactgccaatttgggcaacctctagagagtgggttaagcgtgtgcgataaaaatcatcttcgccaactgcgtgaatttgtgttttggcttgtaaacaacgaaaagcttccgaatgtaaaatgcgtcctcgatctcgttggaatggagaacggtgatcttgttcgcgttgtttgtctgcaataaaacgtgatgtccaagctgaatccattttattttcctccttagtcacagtttaggctataatagctgataattctttttgtttaaaccttattcaaatggcacttttttattctgataattctgcaaaaaaatccgcaaaaccgaccgctttacagacctttcatatccaatctttagactatcaaggattcggcgtggcgaaagtcaatggcaaaacgtggtttattgaaaatgcgttaccgaatgaaaaggtggaagccaagattattgaagataaacgccaatatggacgagcgacagcggtacgatttctacaaaaatctgcagatcgccaaacgccattttgttcaatctatagccaatgcggtggctgtcaaatgcaacatattccactggctttacagcgagaaacgaagcaacagacgctttttaaccgtttacaaaaacttcaagcagagcctatcagatttgagccaatgcttgtcgggcaaggcacaaactaccgccgtagagcaaagctgagtatggcggttcaaaaaaatacgttggtggtcggctttcgccaagcgaatacgcaagagattatccctctaaatcattgcgatattcttgagcctgaacttaatacgcttttacccaaattacagcaactttttgccagttggaaaaataaaaaacagttagggcatattgagctggttcaggcggataatggggtggcattgctgttacgccatatcggcgaacttcattcacaagatagtgataaattacaacgctttgtggaacaagaaaatcttttgttattcgtgatgacagataaagatcagattagtcagtggcgtggtgaagttccttattatcaaatcaacggcttaacgcttcacttttcgatccgtgattttattcaaatcaaccgagaaatgaacaagcaaatggtgaacaaagcgatagtgtggctcgatctgcaaccgacggatcgagtgcttgatctcttctgcggaatggggaattttaccttgcctatcgcaccgtttgttgaagaagtggttggtatagaaggggttgagccgatggttgcacaagccaaacagaatgctcaaacaaatcagattaacaatgcgaagttctaccaaacggatctggataaaccttttgtggatcagccttgggctaaagcacattttaacaaagcactactagacccagcacgcaatggggcttactttgccttagatcatctttgcgaattacaaccagagcggatcgtgtatgtttcttgcaatccagcaactttagtcagagatgccgaaaaactgattgcaaaaggatatcgtttaagccaatccgcaatgattgatatgtttccccatacggcacatttggagtcgatttcgttgtttgaaagaagaacaaagaataggttctctaattaatgaattcctatgtagactaaagttataatgttcttacttttgtcgcagccaaaatttttcatatatggttaaaatagaggagatgttagatacaaatccagaacatttttttaacaaaaaagcgatttttaataaaaaaaagtattgcatttcataaaaaaacttatatattccattttgtcgggtaaaaaaataacccctcaaacacaacaaaaaacaactatcacttggagtgaagcaatgaaaaaattaacacaactctctttattagcattggcagtggcttctgggtctgcaatggctgcaccaaaaacctttgtttattgcttggaagcatcaccttcttattttagcccagcattaggtactgatggtgcaacactagatgcaagtggccgtgccatttttaataaattaaccgattttaaagaaggtgaaaccaccgttgttccatctttagcggaaaaatgggacgtttctgcggacggtaaaacttacacattccacttacgtaaaggtgtgaaattccacactactaaagatttcaaaccaagccgtgattttaatgcagatgatgtacttttctcatttaatcgtcaattagatgcaaatcatccatatcacaaagtttcgggcggtaactacgagtatttcgttggtatggatatgcaaaatatcattgataaagtggaaaaagttgatgactacacggttaaaattagcttaaaagtgcctaattcaccgttcttagcaaaccttgcgatggactttgcttctatctactcggcagagtatgctgataagatgttagcagcaaaaacaccagaaaaattagatagcaatccagttggtacaggtccgttccaatttgtggattaccaaaaagactcaaccgttcgttacaaagcctttgatgattactgggcaggtaaagcgaaaattgatcgcttagtgttctctattacgccagatgcatctgtacgtttagcgaaattacaaaaaggcgaatgtcacgcaatgccttatccaaaccctgcagatattgcaaaattaaaatcagatccaaacattgaagtattagaaaaaccagggttaaacgtgggctatttagcgttaaatatgactaaagcgccgttggataaccaaaaagtacgccaagcattgaaccacgcaattaataaacaagcgattattgaatcggtgtatcaaggttttgcaaaagtagccaaaaacccaataccaccaacaatgtggagctataatgacgacgtgaaagattatgactataatcctgaaaaagcgaaagcattgttaaaagaagcaggctttgaaaatggctttgaaacagaattatgggcaatgccagtttctcgtccatataacccgaatgcacgtcgtatggcggaaattattcaagatgattggaaaaaagttggcgtaaatgcgaaaatcgtcagctacgaatggggtgagtacttaaaacgtttacgcaacggcgaagcctctacttcaatgatcggttggacgggcgataatggtgaccctgacaacttcttaaatacgctattaagctgttctgcattagaagctggctctaactatgcgaaattctgttataaaccgtttaacgatttagtggttcaagcggctcaagaaacagatcaagcaaaacgtactgagctttataaacaagctcaagtgattttcaaagaacaagcaccgtgggtcactatcgcccactcaacaacgtacttcccagtacgcaaagaagtgaaaggttatgtggttagcccgttcggtttacataacttctaccaagtagatttagcgaaataaggcaacattgtagggtgggtcttgacccaccttttagtttagttatggtgggtcaagacccaccctacaaattgaaaaacgctgagatatttaatgtttcaatttattcttaaacgtcttttaatggttatcccaacctttattgcgataaccttgattacctttgctcttgtgcatttaatccctggcgatccgattgagatccgaatgggtgaacgtggtttaacgcccgaagttcacgcacagatgatggcacagcttggtttagatcttccgttacacgaacagtattttaactatatcaagggtgtgtttcagggggatttaggtaattcgtttcgtaataacgaacctgtgctgaaagaattttttacccttttcccagcaacagtagagttagcattttttgctctgttgtggtcgttggttgctggtattttatttggcgtgattgcggcggtgaagaaagaatcttggctttcccacgctatttcgtcgatctctttaacaggttattcaatgccaatcttctggtggggcttaattttaattctttatttttcaacgccattgggcttgcctgcctcagggcgtttacctgcagaatactggatcgaagcggaaacaggctttatgttgattgatacttggaattctgacgaacctggggcattcgtggcagcgattaaatcgttgattttgcctgcgattgttcttggtactattccattagccattattactcgtatgacccgttcttcgatgttggaagtgttgggtgaagattatatccgcaccgccaaagcgaaagggttaaacacaacgcgtattgtgattatccacgccttgcgtaatgcgttaattcctgtggtaacggtggttggtttaattgtgggacaactattatcaggggcagttttaaccgaaaacattttctcttggccagggatcgggaaatggattattgatgcgatcaattcgcgtgactaccctgtgctacaaggttcagtgttgattattgctaccttgattattttagtgaatttaaccgtagatttgatttacggcgtggttaatcctcggattagacatacttaaaaaaatccctcccctaataatcccttcccccgtttacgggaggacaaatgcgatagcatttgagcgttggcttcgccaacgacccgaagggtgagcgaagcgaataacgtgccgaaggcggaaggggggattacaaacagagtttgcaagatttttataaaattaaaccgcttgtagttgcccttacgggcaatcccccctccctaaccctcccccgtgaacgggggaggggaaatatataaaaatagatttatttgttggagtaataaatgtcttctcaagtagaaacaacctcaccagccctactaacacctttacaagagttttggctctattttcgccaaaataaaggggcggtggttggtttaacttttattgtgattgttgggcttgcctgcatttttgcagaatttgttgcccctttcgatccgattacacaaaaccgcagtgcattgttattgccacctgcgtggtttgaaggcggtaattctgcctatttactcggcacggacgacatcgggcgtgatattctttctcgtattatctatggggcaagattatcaatctttatcggtctgttgatcgtcgtgatgtcctgtattctaggggtaattttaggtttgttagcgggttattacggcggcactattgatatcgtgattatgcgttttgtcgatattatgctcgctattccaagcctattattaaccatcggtgtcgtgactattcttggtccttcgcttctgaatgcagcgattgcaattgctgtggtgtctattccaagctatgtgcgtttaacccgagcttctgtgttaagtgaaaaaaatcgtgattatgtgaccgcttctcgtgtggctggggctggtgtatggcgtttgatgtttattgtgattttgccaaactgtttagcgccactgattgttcagatgacaatggggatctctaatgcgattttagagcttgcggcacttggcttcttggggatcggcgcacaaccaccgacaccagaactcggcacaatgcttgccgaatctcgtggctttatgcaatcggcaaactggttggtgacaatcccaggtttagcgattttatctctcgtgcttgcctttaacttaatgggtgacggcttgcgtgatgcacttgatccaaaattaaaacagtaaggggaacgaaatggcattattaaaagtagatgaactttcggttcactttggcgataaaaaagccccgtttagagcggtggatcgagtaagttatgaagtcaatgaaggcgaagtgctaggcattgtgggcgagtcaggttcgggtaaatcggtcagttcccttgcaattatggggcttattgatttccctgggcgtgtaatggcaaattcgttacgtttcaacggacataatctgcttgatttaaaaccaaaagagaagcagaaaattgtcggcgctgatgtagcgatgattttccaagatgcaatgacaagcctcaacccaagttacactgtgggttatcaaattatggaagccctgaaggttcatcaaggcggttcaaaagcgtggcgaaaagagcgtgcaattgaattattgacgatggttggcattcctgatccaacatctcgtttagatgtctatccgcaccaactttcaggcggtatgagccaacgtgtgatgatcgccatggcgattgcttgcaatccgaaattattgattgctgacgagccgacaacggcgttagatgtaaccattcaagcacaaattattgatttattgcttgagttgcaacgtaaagaaaatatggcattgattttgatcactcacgatttagccttagtcgccgagtcggctcaccgtattatcgtgatgtatgcagggcaagtggtagaagaaggcaagtctgaacaaattttcaaatcaccgcttcacccttatacccaagcgttattaaaagcgttgcctgagtttgcagaaggtaaatctcgcttgcaatcactaccaggtgtcgtgccaggtaaatatgaccgtccgcaaggttgcttgctcaacccacgctgtccgtatgcaacggatttatgccgacaaaaagagccagaactacgcacagtaaacggcagacaggtgaaatgccatacgccgttgaatgagagtggattgccacaaccaatttagtaagatagataaatatgcaaaacaatacccaaaacccaccacttctcaatgcggtggatctcaaaaaatactaccctgtaaaaaagggaatgtttagcaagccgaaactagtaaaagcggtggacggtgtttcttttacccttgaacgtggcaaaacccttgccgtggtgggtgaatcgggctgtggcaaatcaaccttaggacgtatgctgacaatgattgagccaccaacagaaggggaattgttctataacggacaaaatttcttagtcagcgatacggaaacagaaaaattacgtcgtaagaaaatccagatcgtattccaaaacccttatgcgtcacttaatccacgcaaaaaagtaggggcaattttagaagagccgttgcttattaacaccgaattatctgcacaagagcgtaaagctcaagtgttggaaatgatggcgaaggttggtttaaaacctgaattttacgaccgctatccgcatatgttctcaggcggacaacgccaacgtattgcgattgcccgtggtttgatgttgaaacctgatattgtagttgccgatgaacctgtgtcagcccttgacgtatccgtccgtgcacaagtgttaaacttgatgatggatttacaagaagagcttgggttgtcttatgtgtttatctctcacgatttatcggtggtagaacatattgctgatgaagtgatggtgatgtatttaggacgttgcgtagaacaaggcaataccaaagagattttcggcaacccacgccacccttacactcaagccttgttatcagcaacacctcgtctggaagcagaacatcgccgtgaacgaattaaactcactggcgaattaccaagtccgcttaatccaccaaaaggctgtgcgttccacgcccgttgtcgtttggcgacagagcgttgtaaacaagaacgccctgagctaaaaaactatgaaaacagcacgaagatagcttgttttatggtggagtaagaattttatatttgttgtacgctttattgccttactctatagtaaggcaatttaatttctaaatctaaaccttcctcgactatatctcgttttcatcaacgccagaatttgctctttttcgcttgataccgcttggctactctgtttagccaccgtaagcgaatgttgaatagagtgagcgtgagtaatggcaatcgccaatgcatctgctgcgtcagcttgaggtttagcggaaagttgtaaaatacgtgtaaccatatcttgcacctgcactttatccgccgaaccgatacccacaaccgtttgttttactaagcgtgcagcatattcaaagacaggtaaatcgtgattgaccgcagcaacaatcgccgtcccccttgcttgccctaatttcaacgctgaatctgcattttttgccataaatacttgctcaatggcaaacatatcgggttgaaactgcgtgataatttctgtcaccccagcgtaaatacgttttaatcgggttggaaggtcatccacggatgtacggattgcgccacttccgagatattctaaatgccgtccagtttgatgaatcacgccatagcctgttacgcgagagcctgggtcaatacctaaaataattgccattttatgtccaaaaagaaagtggatttgttattcacaaacccactttatagtcaatcttaattagataatcaacttattttgtaactacacagttttttgcaagaatttgattgtttgccgtaaacatgacaggtacagttgtttctgctgtttttgcactaaagcctatatctagactccatacatttgtgcctgaaacaaatttcacatcgtcttgataggttgcatctactttcagattttcgcctaccacttttttgttaatggtgactgttgcagttgatggttcgccattgttgaaagtataaaccgctgaaacaggttggtttgttttgccattcacactacaagtgtaagtaacagtttttgagcctgttgtgatattttttgctgcagttgtactatcaacagcagtgctacctgcattaccctcaatatttgctgttgaagatgcaacatcagaaactgttgaacaagctgtaagtatcgcagctgctgcaaatgttggaagtaatttaactaatttcattgcttttccttttgtattaattaaaaagatctctctcttagaaaaggaaaaaatgggaaagttcaaaaaaataatctcaagctaaatacttgagattactttttattcatttttaattaaagcaatgcagccacttcatcactgatttcgccgttgtgatacacgttttgcacatcatcacaatcttcaaggcggttaattaagtctaataattttggtgcagtttctgcatcaagttggactgtggttgatgggatcattgtcacttctgcattttcaactttaaaacctgccgcttcaatgccatctcgcacagcgcctaaatcttcccaagcagtatagatttcaaatgaactatcttcttgtggctgaatatcatcggcacctgcttcaattgctgcttcagtcaatgcatcttcgtctgcacttgcgattaaaattaaccctttcttactaaataaatagccaactgaaccttcagttcctaagttaccaccacatttagtaaaacttggacgaacctgtgagattgttcggttagcattatcacttagacactcaaccatcacagcagttccacccggaccgtaaccttcgtacactttggtttccatattggtatcatcaccaccaccgacaccacggtcgatagctctattgatagtatcacgcgtcatattattcgataatgctttatccactgctgcacgcaaacgtgggttagagctagtgtcgccaccgcctaattttgcggctgtcactaattcacgaattaatttggtaaaaattttaccgcgttgtgcatcttgtgctgctttgcggtgtttaatgttagcccacttactatgacctgccattctcttgtttccttctttttaatttatgtttcaatataagaaggtagggacatactgcgtgagtccacgggctgtccccaccatcattttttaattacaagcggtctgaaccgccaaatattttgcaatcgctttggcattattgggggatttggtgagtgccaccgcatcatttaccgaaagccattgatacgctaaatgttccgttaatatcggctcaatttcatcgggtaatgccaataaaaaccaatgctccgtgttatgcgtaacgtcaggggcgtatttataacggaattgcggaaaaatctcaaatttcacactcgttttgcaatcataaagtgctaaattttgagcaataatatcaattcctacttcttctcttacttcacgcaatgctgtttggtaaggtgtttcccctgtttcaatcgtccctgtcaccgactgccaaaaggttggatcgtcttgccgttggagcattagtactcgctgagttttttcggtataaattaccacgagaacagaataggaatttttgtagttcatttttatgtaccatataagagtttttacatcggatatgtgcgctctacctttatcgtttatgctttttcagcatgtgccagaacattgtaaaatttcaaagagtaaataacaagattagatattgaaatgaattgattagtcaaatcgtgcgattttttctgagaaatgaatgcttaaatttatgctaaagcggtgagattttcataagaatacgatttcaaatttcccttatatcaatttttttgttatcctaaccacatgtaattgaataggcttatcttatatgaaatttattagaaaaaatgctgtatcgtgcatcatgttaagtagttttttatctataagcacttatgcaaatcccttgaaaaccatcttacagaagaatttatcaaatgcacctgaagtgaaagaagcgcttgcaaacgttgaagctgctcagaatcgtgttgaacaaagtaaatctcaacattttcctattgttagcgtaacaggttcaaaaactttaagacagtatcataagtatgaagataattatggttcaaccaaaataatacctggtattcaggctgaaatgaatatctttgcttttggcgctattgagaaagatattgaacgcagttataaagagaaggagtactataagcatacctataccgctactcaagaggaaatagcgtatactattggacaactttatttaacggcactgaatatgaaggaagccatttctgtaatggaaaagagcttatttcgccaccagaaaattttacaggatttggatattatcatggagaatgatgaaggacgagaatccgaatttgttcaagctgagacacgtatgttgatggttcaacaagaaattaataattatcgacaaaaattattagctactttgaatacgctatcaaaatatacaaagactaaagttgttgaagaacaattaagtgatcctttccttcagttgaaggaagaacagctttatcaaaaatataccttaaaacgaaaggaggataatcctctttaccaagctaatatttccgatttagatgcaaagaatttgtcagtagatgctgagaagaaaaagcagctgccacgcattaatcttgtcggttcagcaactcaggagaatagacagattggcttaaaggttgagtgggaggtatttaatcgtggtaacaactatattgcgaaagaaaaagctagccagatctcagctagtcgagagcgtttattacgcacagcaagggatattgaagaaggtgcaaatttagcaaaaattaatattaaggaaaaccgagtacagttaggtgtattgaagaaacaaatcgtttcctctgaaaaagtgattgatttctatcgaatgcagtttgatattgcaagacgtacattattagatgtattaaatgcggagaaagaattatctaatgtagagttatcttacgcaactacacaacataatttacgcttgtctatattagattatttgtatactcaaggaatgatctctacttggggcgatgtaaaaaaacaggttatacacccttaattctacagtgtatagataaggggatattgttatcctgcttctcatttattgggcggattgagccgcctattttacttatttgatttgaaaataactttaaaaaatccataaattaggtttaggatacttatgaaacatattattgaaaatttatctcttgcaacccagttgcttggagcgaatttatcagtagcaaccttaactgcacatacaattcgcacagaaaatatggggttagattttagttctctacgagagtacttaaaaagtgagggattcgagaatacactctcaaagagatctttaagagaaattcctagtttagccgtacctgtattattatttctgcagaatgaggaagctgcattagtcacggaaattaaagaagatagtgatggccgctcttataaagttcatttattagatggattaacacaatggttttctgaaaatgagttagaggaaaaatatctgaatcattgttggtttattaagccaagagaaagtgtagacactcgttccgatctaccagaatataatttacctaaggcttggttctttaaagtaatttggcgatttaaaagttattattatcaagttgtattatctagttttattgtaaattttctagctttagtgagttcactatatgtgatgaatgtctacgaccgtgttgtcccaaataaggcatatggaacgctttgggttttaagtctaggtgttattgctgcaatcgtatttgagcttattgcaaagatgctgagagcttatttgacagatatggcgggcaaaaaatcggatttgattattagttcggcattatttagacgagttttaaatattaagttgcaagatagaccaacatcttcgggatcctacgctaataatcttcgtgattttgaatcagttcgagagtttatgactagtgctagtctacttactttggttgattttccattcttatttttattcttatttgtgatgttcatggttgcagggaaattagctcttgttcctcttgcgatcattcctatagttattattgttggattgttagcgcaaattcctctttctcgctatattaatgaatctatgagggaaagctcccaacgtcaaggtttaactgtagaggccattgaaggcttggaaaccctgaaaacaaacaatgctgcgaattgggcgcaaaaaaggtgggattttttcaccgccaaatcggcttcgtcttcaatcaaagtaaaaaatattagtaattttgtaacgaattttacgatgatgatgcagcagcttaatactgtttttttagtgttagcaggcacttatcttattcatagtgagaatccagatagtaaaatcactatgggagcattaatagcttgcgttattttatctggacgagctttagccccgttaggacaaattgcaggattggctattcgtttccaacaggcttggttagcactaaaaggtgtaaatagtattgttgaacgcccgagtgaacgagataatgagcggaattatgtgacactgaaatctattcgcggagaattacagtttaacaatataacttttagttatggaaaagaagatgagccgacgattaatggtcttaatttagacattaaacctggagagaaagtaggaatcttaggaaaaataggatcgggtaaatctacagtattaaaattagcttcgggcttatatgatcctaaacaaggaaatattactgtagatagtgtagatttacgccaaattgatccacattttttacgtaatcaagtgcttctgcttgagcaaagtcctcgtttatttttaggtacattacgtgaaaatctagatttggctagaatggatggtttttcaacagatcaagatctattgcaagctctcgctcgttttgggctaattgatttaattcgtaatcatcctagaggattagatatgccactgggagaaggtggtctaggattatctggagggcagaaacaaatggttgctttagccagaatgacaatgaagaatccccgtattgcattgttggatgaacctacaactggtttagatcaaatgtcagaaattcaagcgctacaggggattgcacaatgggcaagaaataaaacgttagtggttgtaacacatagatcacaggtattacaaattgtaaatcgcattgttgttattgaagatggtaaagttgtattagatggtcctagagatgcggtattaaaacatttagctagagatgagagtgaagatacttctcgtgagcaggaaaagtaatagcgatcttacagtataaaatctgtgtaatcaaaattactttatattaatcaatttatattaggttaatgcaaaaatggataaagataaaaatcctaagttattagatgaaaagttagaaactacgaattcagaaccaaaagagattggtaagcagaaagcagctaaattgagaaataaagatctgtatttattaaatgatttacatgcagcattacagcaggaagatcatcgttctatttttgcaacaatatctttattttttactttattagttgtatttgtcatttgggcttataatagtcctattgatgaggttactcgtggacaaggcagtattattcctacaagccgagaacaggttattcaaagtttggatcctggtattcttaaagaaatgcttgttaaagaaggtgatacggttgacaaagatcaagtgttattaaaactagatgatactagaagttctgctattttgagagaaagccaagcaaaagtagaaaatctagaagcattatcggctcgtttaaaagctgaggcttatggtgtggagttggtatttgcagagacaactccagtacagctacaagagcgtgaacgtgctatttacgaaaagaagaaaaattctcttaaagaatccttagatagtttacaagcaagtaaggcattgttggatagagaaattcaaatgacagagcctatggtagctagaggagcagtatccgaaatagagctgttacgtatgaaacgccagtctagtgatttgcaattacaattagcagaacgtaaaaataagtatgcgacagatgcgagtgctgagctaactaaaatagaagctgagttatctcaagcccgtgagaatatggctatgagagccgatcctgttgaacgttctcatattcgttccccattaaaaggaatagtaaaaaatattcgagtaaatacaattggtggtgtaatcaacgctgggcaagatattatggaaatagttccgattgaagatacattgctcgttgaggcttatattagtccaagtgatgtagcatatgttcgtccaggaatgcctgctttggttaaattaactgcttatgattatgctatctatgggggacttgatggaatagtaacattacttagtcctgatacattgcatgatcaaaagcgtcctagtgatttgaagctgaatccaaatgaagcctattaccgagttctagttaagacagatggcagccatttgactgataaagatgggaaagtaatgcctattatccctggtatgattgcgtcggttgatatcaaaacggggcagaaaaccgtatttcaatatttaattaagccaattactagaatgaaacaagctctacaagagagataatgtatttagtttaatattttaaatatcacaaataagtcctatcttttctaatagatgaataacaatgttcattctccttctttattttttataaataagaaggagaagtttattttgccacatatctatgattaatttcttctttctgtattggttaatatggttatgttgacatctactctctactcatatttagttcttgtgggagtgaagctagtaatcatatagataataacttattcattaatatgtgtcttctttatatatgtcgataggtagaattaaggacaatgcaaatatattacccaaattatcaaggatctgaccgcttgttagatctcacttccccgaaaattatggggattttaaattttacccctgattcgttctccgattcggggcagttttttacccttgataaagccctgtttcaagttgagaaaatgctcaatgacggagcggatattattgatattggtggcgaatccacccgtcagaatgcggaaatcgttacccttgagcaagagttggaacgggtcgtgccattggttgaagccgttcgcaagcggtttgattgtttgatttcagtggatagctcaaaggcggaagtgtttcgtcaatcagccttagttggggcggatattcttaatgatattcgtgcgttacaagagccgaacgccttagaaactgccgtagaattaggcttgcctgtttgtttaatgcatatgcaaggcacaccgcaaaatatgcaacaaaatcctaaatatgatgatgtggtggaagaagttgcagattttctcaatcaacgtatttttgcttgcacaatggctggcattcccaaagagcatattattttagatgtcggctttggttttggtaaaacggtgcaacataactatcaactgctaaaacatctaaacgcctttgtcgcttcgggctatcctgttttggcagggctttcccgtaagtcgatgatcggcaatgtaatcaataaaccggtcgatcaacgtgtcgcaggcagtatcgctggggcattgctcgcggtgcaaaatggcgcgaagatcgtgcgagttcacgatgtgacggaaactgctgacgctttgaaagtgtggcaagcgatgaatgaatgtgaataaaaaggaagacaaaatgacaatactctacggcattaaaaactgtgataccgtgaaaaaagcgatcaaatggcttgcagataacaaccaaaacccacagcttcacgactaccgtgttgatggcttagatcctgcgtggttagctgaaatggcagagaaatttggttgggaaaacttagtcaataaacgtagcaccacttggcgtgggcttgatgatgagattaaaaataatcttaacaaagagctggcattaaaggtgttaaacgaacaaccaaccttaatcaaacgcccgattgtgattgctgatgatgctgcgttgattggttttgatgagaaagagtatcaaaaggtatttatgaaatgatacccaacatattaattatgttgagtaaatgggggcaattttaagggctctctgtttattcaaaggtattggataggatttggatcatgagttatattgtagctcttactggcggtataggaagtggtaagtcaactattgctaatctttttgctgcacttggtgtgccagtgattgatgcagatattattgctcgaaatatcgttaagaaaggcagtcctttactcgcccaaatagtagctcattttggcaaacaaattttgtttgaaaatggtgagcttaatcgtacagcattacgacagcggattttccagacagaatatgagagactgtggttaaatcagttacttcatccagctattcacacagaaatgttaaagcagttgaatgaaagccaatctccctatgtgctttgggttgttccattattgattgaaaaccagctaatggcattatgtgatcgtattttagttgttgatgtattgcctgaaattcagctagaacgagctatgaagcgagataaaagcaatgttgaaatgataaagagtattatgctatcacaggttgatcgtcaaacacgattaaactatgctaacgatgtgattgaaaataatttaccttttggtgataatgaagtccatctgactcatcaagtggcaaaattgaatgaatattatttgactctaagtaaaacaaaggggaaatagatcatgctcgtcgtattctgtccaaattgtggcaaagaagtggcttgggttttgggcaataaatatagaccattttgcagcgaacgctgccatttagttgatcttggcgaatggctcaatgaagaaaatcaagtccttgaaagtgatattcagtctgcagatgactatgatatggtggtaagtgagggtattttctaatgaaataacaaactaaaccgttcaatgccttgccaagcctcatcactaaattcttgttttacctgtttttccaattcggcaagggattgaatgagttgatagagtttatggtaagttaaacgttgtactgcagcttgataaaacccacggcggttttgccatactttcaagcggtcaaattcggctcttaaattaccgctatacagaggttggtgactattgataatcggctgtggtgagcgtgtcatttccagtaataaaagtagctctttttgtacgatgcgtagcaacaccactggttgtatctcttcattctgcagatgttgaagcactcttaatgctcggttaatttttccttctaataaggcatcaacccattggaatggggtgaattgtgccgattgttcgatcacttcttttgctcggtttaatccaatcttttgttcagcaaaacgaagttgtaacatctgcaatgcttgttttagtgccagtagattgccttcgtagctataacaaagtaattgaatagcatcaggcttaagctgcaactgcattgttttagctcgatgttgtagccaaataggtagttttgtaatatctggtgtttgacagtttacgactacggcattatttagttgtacaaaccagctctgtttttccattgctttggttagttttggttggtgcagaacaaaaagtaaatccgtgtgagaacaagccagtagttcagatagctgtgtttgctgtgttacagtttggttttcaggcaggttaagaattagaatttggcgattaaaaaaaagcccatttgattgaacgaggtcaaacaacatatcccattgggtatcattggcaatggtaaactcttgtttttcatcaaaatcctgtaaacgagccgtttgtacaatacagtcttttgcttcaccaaccaataagagatcctgccctgtcaataaataaaacggctgtaagcctttattgagggcagattctaatccttctgggaaaatacgttgcatcatcttatttcgtatttgctaactctttttgtaatcctgcgactttaataagaagttggcgagaggcttgttcatacatttgacgctgaatactttcttgctcttctgatttcgctaaagcggcacgagagtcatcgaagaatgtacgatgaacgctagtttcaatcggatatatccctttatttggtattgttaccgttgcttttacggttaagctaaggattttttcagcttcacgcgcttgtttaaagactgatgcaacacgagattcactttctgttgcatttaaacgtaaattcgcaacgttagtagatttcggtacgatttgaatgttactgagtaacatttggttacgcaaaatgcgtgacatatcgctgtattggtccgcactttcaaaactcagcgtacgcaattcttcagggaactgttcattgtttttaaaatgccaaccgcaagcggttaaaaatagcacacaaatgagagagagtttttttaacataccatattcctattttgtatggtgggtcttgacccaccatatacgatgtagattagatggtgggttaaaacccaccctactattatgctttcaccgcaaaactcaacatcttaaacggtacatagatctctttcacgatttctacaccttcaagatatttcgccacattttcatcggctttcgcaatcgctttgacttcatcttccgttgcggttgcagatacagtaattttaccacgcactttaccatttacttgcaccacaaccagtttttcatcttctatcattgctttttcatctgccacaacccaaggtgcaaagtcaattgaaccctcattgcctaaggcttgccatagttcaaagcagatatgtggggtgattgggtagagcatacggatcaccgcatttaatgcttcagccatcacggctttgtcttgatcattaacaagcggtgctttggtgagcttattcatcaattccataattgccgcaattgcggtattaaaggtttgacggcgaccgatgtcatcactcactttcgcaatggttttatgtacgtcacggcgtaaatctttttgctctttgcttaatgccgtaggatctaatgcaacagtggctggcgattgtgcatactcataagccaagttccaaagacgacctaagaaacgtttcgccccttctactccagactcttgccattctaatgtcatttccgcaggggaagcaaacatcataaatagacgcaccgtatccgcaccatatttttccaccatttcttgtggatcaataccgttgtttttcgatttcgacattttggtcataccgctgtgtaccaacgcacgcccttctttgtcaaaggctttcaaaatacgccctttttcatcacgttcaactgtcacttctgttggcgacacccaaatacgttcattggttgggctggtgtagtaataagcgtccgctaacaccataccttgacagagtaatttttctgtcggttcatcgctagtcacgaaaccggcatcacgcaataatttgtggaagaagcggaagtagagcaagtgcattgttgcgtgttcgataccgccgatatattgatccacaggtagccagtagtttgcttcttctttgtctaacataccttgttgatattgtggcgacgcataacgtgcataataccaagaagactccataaaggtatcgaaagtatctgtttctcttaacgctggctgaccgttataagtggttttcgcccattctggatctgctttgatcgggcttttcacgccgtccatcaccacatcttcaggtaacaccacaggtaaatcttgcattggtacagtcacagtttcgccattttcaagggtaagcattggaattggcgccccccagtaacgttggcgagaaacgccccagtcacgcaagcggtaattgacttgacgtttaccgatccccattccttctaatttatccgcaatacctttgaaagcgccatcaaaatctaacccatcaaattccgcagagttaatcaatttaccgtgttcagtcattgccgctttgctgaaatcccattcagaaccatcaagcggtgcgatcacctgtttaattggtaaattgtatttttgtgcaaattcaaaatcacgctcatcgtgagcaggtactgccattacagccccagtgccgtagtgcatcaacacaaagttagcgacccagacaggaacttcttcgcctgttaaggggtgaatagcaaacaaccctgttgccattccttttttctccattgtggcaatatccgcttccgccactttggtgtttttcgcttcttgaataaaggcagctaatgcaggattgttttctgctgccagggttgctaatgggtgggccgcggccactgccacatagctcacaccaaagaaagtatctggacgagtagtataaacaggcaaggtttgatcagtgcctttcactttaaaagtaatttcaaccccttcagaacgaccgatccagttgcgttgcattgttttcacttgatctggccataacggaagacgatctaagtcatttaacaattgctccgcatagtcagtaattttaataaaccattgcggaatttctttttgttccacaggggtatcacaacgccagcaacagccttcgtggacttgctcatttgctaataccgtttcatcattcggacaccagtttactgtcgatgttttcttatatactaagccttttttgtacaattcagtgaagaaccattgctcccatttataatattcaggacggcaagtggtcacttcacgatcccagtcaaagccaaaacctaaggccttgagctgatttttcatatattcaatattttcataagtccattttgctggtgcagttttattttttaccgctgccccttctgcaggcaagccgaatgcgtcccaacccattggttgtaacacgtttttgccgttcatacgttgataacgggaaaccacatcgccgatcgtatagttacgaacgtgtcccatatgcagacgacctgacgggtatgggaacatagataaacagtaatatttcggtttgctttcgtctttaattgctttgaatactttattttctgcccagtactgctgtactctaggctcaatcgcacttggattgtattgttgttgcatcatctttattcctcaaatttgtcgaaaaattgcggtatagaatagcgtaaaaatggggatttttgaaatgaaagcggtaagattttagggattttttgcaagagtaggctaagtttaatcctttaaagctatttaaaggtttggaatgggtaatttttattgttataagaaccgataaaaataccttcaactgaaactttgactaacccatattgttttaaaatggactcaaaatgaaacaacacttctccatcaataatgtgtaaaaaatcatttttaaatacggcggagaacggaaaggacaaagtctgatcttcaactaaaaattcaaccgaaagcgttgcaccataagcataacgttcagttaaaagttcttttgagtctgggttaggtttaattgaaaatccactgccatcataatagacaataaatttatgagagtggctttcacaatcgaaagcaaagacgtgattatcttcaaatagccattttgttgaaaatgaattaaaaagtgtatctaacatttttacatctcctccaatgccattgatatacaatttgtagtataaacaaaattaaatagtgaagcaaactccgtagatgtaaattggtcatttgttcatgctttaggctatgtcagcaaagcctaaagccccagcaaaattacctgatcgagaaaatctcagggaaattttggcttacaacattcaaacgttgcgtgtgcaaaaaggttggtcacaggaacgattagcgaatgagtgtgagttagatagaacttatgtttcagcggttgaacgttgccgctggaacgtttcgctttcaaatattgaaaagttagcaactgcactttcttgtccagcttggcagttattgaaatacccagaaaatagcaatcaaaatactgaaagaaatttagatttgtgttaaaattcgctggctttttcgtccgcccgattgttagggcgagtaaagcaacttgcaaaaaattttgaaaaactgaccgcttgcaagcggtcttttgttttgaaaaatttacgaatttcaatgatttacacgtagggacacactgcgtgtgtccgttctattttgtattgatgatatttagcagacacacgcagtgtatccctacgggaataacataaaccaacaagtaacctttcgtatgggttaccactgtataaggattaacaatgccaattattactttacctgatggctcacaacgccaattcgacaatcccgtttctgtaatggaagtggctcaaagtatcggtgcaggtcttgcgaaagcaacgatcgcaggacgtgtaaacggtgaacgccgtgatgcttctgacattatcagcgaagatgctacccttgaaattattactgcaaaagatgaagacggtttagagattatccgtcactcaacggcacacttactgggtcacgcaatcaagcaacttttcccgaatgtgaaaatggcgattggtccgacaatcgacaacggtttctattatgacattgatttagaccgctctttaacgcaggaagatcttgatgcacttgaagcgcgtatgttggaactggcgaaaaccaattacgatgtagtgaaaaaacgtgtgagctggcaggaagcgagagatacctttgagaaccgtggcgagtcgtacaaaatggcgattttggacgaaaatatcagtaaagatgaccgtccagcactttatcatcacgaagaatatattgatatgtgccgtggtccgcacgttccgaatatgcgtttctgccatcacttcaaattacaaaaagtggcgggtgcatactggcgtggcgacagcaagaataaaatgttgcaacgtatttatggtacggcgtgggcagataaaaaacaacttgccgactatttacaccgtttagaagaagcggcaaaacgtgaccaccgtaaaatcggtaaagcgttagatttatatcatatgcaagaagaagcaccgggtatggtgttctggcacaatgacggctggacgattttccgtgagcttgaaaccttcgtgcgtaccaagttaaaacagtacgattaccaagaagtgaaaggtccgtttatgatggatcgtgtgttatgggaaaaaacaggtcactggcaaaactacggtgatttaatgttcaccacccagtcggaaaaccgtgaatatgcgatcaaaccgatgaactgcccaggtcacattcagatcttcaatcaaggcttaaaatcataccgtgatttaccgttgcgtatggcggaatttggttcttgccaccgtaacgaaccgtctggttcattacacggtttaatgcgtgtgcgtggctttacccaagatgatgcccatattttctgtatgccagagcaagtagaaagcgaagtcacatcgtgcattaaaatggtgtatgacatttacagcactttcggttttgaaaatattcaagtgaaactctcaactcgccctgcaaacagtatcggtacagatgagatgtggaacaaagcgcaagcagacttagcagcggcattaacggctaacggtttagcttacgaaattcaagaaggcgaaggtgcattctacggcccgaaaattgagtttgccttgcgtgactgtttagatcgtgaatggcaatgcggtacgatccagttagacttcttcttaccagagcgtttaagtgcatcttatgtggcagaagataatgaccgtaaaacaccagtaatgatccaccgtgcgatcttaggctcaatcgagcgtttcatcggcattattaccgaagaatacgcaggtttcttccctgcgtggttagcaccagttcaagcagtcgttatgaacattaccgacagccaagcagaatacgttcaacaagtggtaaaacaactttctgatgctggcttgcgtgtgaaagcagatttacgcaacgaaaaagtgggctttaaagtgcgtgaacacaccttacgccgtgtgccttatatgcttgtttgcggtgataaagaaatcgccgaaggcaaagtgtctgtgcgtactcgcaaaggtgcggatttaggtacttacaaagtagaagagtttgtcgaaatgctcaaaaaacaagtgcgtggacgtgagttgaagttacttggggaagagtagtcagtttagatacactaggaggccaatgtagaggagagtaattctcctctcattactaataggcatagtagacaaaagtgttggttttaattattttccctaattattaccaactctttttatttaaaaaatcctttataaacataatcttatgctttttcgttaatccattatgaaccgataatttctgtttcagttctttaaataacccttccaacctatttgttgttttttctatatttaaatgagtatattcttcaaaagtgagtttaaagccttgtactataaggctttagcccactttttaccaacacttttctactatgccaaatatcctatctaaatcaccgctttcattagatttccgcctattatttctagcttttattgataaaagttgaaaaattcttgttattttatctttagttttgtgtaactcttgttttttttttttttttttacaatgggagggttcatttgtgcatcctgaaaatgtaaataaaggtttacgatgttttattaggaaaaacagtagagaaggttattatgaataaaatatttagagttatttggagtcatgctcaacaggcttgggtggttgtgtctgagttagtaaaatctcataccaaaacatccgcttacacggataaaagagctcaagtatgcacctcagattattttttagataaacagcaagataaatttaaattaagtcttttaagtctagtattactaagtatattttttaatccagtattaggtgttgtaaaacacacaggacaaccatatcttcgagatggttctagtcaatcgaagctaggaactgacgacggtactattggtattggtaaaagtagtaaggctgggtatggtgctattgctatcggtcagtattcaaaagctaaagctaggcataatgttgcgataggttataaagcagattcaggaatacaaccaaacactattacgataggctacgagactaaagtaagtgggatggaaggaattgccatcgggaaacagtcaacagcgggagagaaatctgttgtcttaggcggacaagccaaggggacaagtactcaaacagttgtagtaggtaaccttgctattgcaagtaagttacaatctattgctatcggtgcgaatagtaagtctaccgatgagtacggtattgcggttggtggtggtgcaactgctggaaaaaacgccgttgctgttggtagggactcgaaaggtgctggggaagattccattgcgataggtaattctgcgaaaacaacaggggcagactctgttgttgtgggtgccaatatcaatgtgacaggtgaaaaattagtggcaattggacgccaagcaagtgctaaaagtcattctactgccttgggttataaagcctctgccagtggtatgcactctgttgctgtgggtgataatgccgtgacaaatgatggtgctgctagagcaaccgcacttggtaataataccgttgtcaccgtgggtggcggtgtggcattgggttatggatcaagagcagaaacggctggaaatgttgctggagaaagacaagctcattcagttgttactgaggagaaatcggaagctaatggctttaaatctacagaaagtgttgatggtaatgctattggtgcggtttctgtcggtttagcaggtaataaactcatcaaacgccaaatcgtcaatgtggcggcaggtaaagaattaaccgatgcggtaaacgtggcgcagcttaaatcgctcaccatgcaaacaggaggcgataacaacagcagtggcaaggtaggcatttggaatggtacgcttaaagtagtgggtacaagcggtgagattaagacttccgcaagcggtgataccatcacattgaaattagatgaaacattgaaaaataaaattgataatattgacaatttaggttggaaacttaaaattgctaagggaatggggggtgaagcaactccacctgcggaacattttgtcaaaatgagcgatacggcaaccgtaacctttaccgctggaaataatattaaattagaacaaacgaacggaaatattacgatttctacgattggtaagttaattaaagagactaaaatagtagatggtaatttgcaaattacttatacggatggcaagactgatactattgctaaggggaaagacggtaaagatggtgagaaaggtgagaaaggtgatagaggggaacaagggtctccaggggtagcaggtcctagaggtgaaccgggtcctaaaggtgaagctggtcctgcgggtccagctggaccacaaggtaaaactggtcctgcaggtccagctggagcaacaggaccacaaggtccaaaaggacctaagggcgataatggtgatccaggaccaaaaggcgataagggtgaccctggtgaagcaggaccaatgggccctcgaggtcctgcgggtgcaactggtccagcaggggctaagggtgaacagggtcaaaaaggagatacgggtccaaaaggtgatacaggtcagaaaggtgaaactggacctacgggtccaacgggacctaagggtgacaaaggtgatacgggtccagcaggaccacaaggccctgcgggtccaacgggaccacaaggccctgcgggtccaacgggatcacaagaccctgcgggtccaactggaaattcggaattaaaaggcattacgtcgatagccaatggtaacgacgccaccaaggagaatggggctaagattaccttgtctgcaggttctacagataaaacagttaatgttaatgatgcgaaaattaccaatgtggcggctggtacagcagatactgatgcggtgaatgtgagccagttaaatactaaggcagcagcttcaaaaacagaggttaaatcaacggacaaatcggttggcgttacagcaagtaaaggtgacaaagatcaaacgatttatgatttatcggtggtgaaatctaaattgaaggctgctgaggataaacgtacagttacggctgaaaccaagggcaatgcttttgtaacaggtgaggaagtggcgaatgccatcaacaccacaaccgcagcggcgagaactgaggttgaagcgggtaaaaatgtgaaagtcacttcaaaaacgggtgcaaatgatcagaatatttacaaggtgagcgtgtctggagatttaagcgacattacttcaattagtaatggcgataccaaagtatctttaggtaaagataagcaaggaaatccagttgtaaatatgaatggcgccagaattaccaacgttggagatggtagtgctgagggcgatattgtgaatgtgcgtcagctcaacaaagtggtttcttctgtgaatacaggatttaatcaattatcaagagatattggtcgtgttgatgttaatgcaagagcgggtattgcttctgctgtggcgatggctaatttgccacaaatttctttaccaggtaaaagtgctatttctgtttctaatgcacaatatcgcgggcaatctgcctatgctataggttattccaaaatttctgataatggcaaatggcttattcgggcgtctgttagcagtaatactcagcgggatactgcgattggaggaggggtaggttttgtgtggtaatctagcacctataaattagaatttcatgctcaatgccattgttattttaacaatggcattgtttggcatagtagacaaaagtgttggttttaattattttccctaattattaccaacacttttgtctactatgcctactaatatagagtgctcacaaattcaccacaaatttcccaaccccaagatcatcttctttgcgagtacgattaatcacactttgagcggattcaataacacgtaaacccatctgatcttcggttctcaccacttcaccacgcaatgagttggtataaacatcagtaattttaacatccacaaatttgccgatcatattaggtgtaccttggaaattgacaatacggttgctttcagtgcgtccggttaattccataatgtctttcttagatgggccttcaactaaaatacgttgttccgtacctaacattgcacggctaaattgcattgcttggttgttgatacgttgttgtaagcggtataaacgctcttttttctcatcttccgtcacatcatcaggcagatccgcggctggcgtacctggacgagcagaatagataaagctgaagctcatatcgaaattgacctgctcaatgattttcattgtttgttcaaaatcttgagccgtttcacctgggaagccaacaataaagtcagagctgatttgaatatcagggcgagcctcacgcaatttacggataatggctttatactccaacgccgtatggttacgtttcatcattgttaaaacacggtctgaaccactttggataggtaagtgtaagaagctcactagctcaggggtatctttatatacctcaatgatgtcgtctgtaaattcaatagggtggcttgtggtataacgaacacggtcaatgccatcaatcgaagcaactaaacgtagtaattccgcaaaagaacagataccgccgtcaaaggtttcaccacgataagcgttcacattttgaccaagcaaattcacttcacgcacaccttgttcagccagttgagcaatttcaaataacacatcatcgacaggacggctaacttcttcacctcgtgtataaggtacgacacagaatgagcaatacttattgcaaccttccataatggacacaaatgcagttgggccttcagcacgaggctcaggtaagcggtcaaatttctcaatttcagggaaactaatatccaccactgaactttttccgccacgaatttggttaatcatttcaggcaggcggtgtaaggtttgaggcccgaaaacaatatcgacgaaaggggcacgttcacgaatatgttcaccttcttgtgaagctacgcaaccacccacaccgataattaaatcaggtttatcttttttccagtttttccagcgaccaagttgagagaacactttttcttgtgctttttcacggatagaacaggtgttaagcagtaatatatctgcatcttcaggattttcggttaattctaaaccgtgtgtgctatttaaaaggtctgccatttttgacgagtcatactcgttcatttggcaaccccaagtggtaatatgtaattttgccattttcaaataatagataaatcagtaagtaaaaaataaaagtagagttgtttatcctttggaacagggtgtaccttattttacatgtttgtatatatcatcgctataaaaaagaaaaccacgaccaaaactcgtggtttttattcaagtagtgtaactattttgttaaaactaaaacagtactttcacctgccacaacttctccagacaatttttgaagatttgttacttcatccatatttgaaattacaacaggtgttaatactgattttgctttagattgaagtaattcaagatcaaatttgatgataggatcaccaactttaacctcttgattttcttctgcaagacgtgtgaaaccttcgccttttaactcgacggtatcaataccgaagtgaacaaaaagctcaacaccatcttctgactcaatagagaatgcgtgattagtttcaaagattttaccaatcgtaccgtttactggggcaacaatcatatcaccagtagggcgaatagcaatgccatcacctacgatcttttccgaaaacacaacatctggaacatcttcaatatttacaatttcacctgaaagcggtgcatagattttcacttccttcgcaacagcttcttttttgccgccgaatagtttgtcaaaaaatcccataatttaatctccattattaaatgaacaaaattctcgcatattttatacgagaattttgtgtttgtattcaattttagttaaggttttggtaaaactcatcaactaaacgttcaatatctgctgctgttggttgtgcaagtgctttatctgcaagagctttggcatcagcatagttgatactgcgaacaagttttttcacatgaggtactgaaattgcactcatactaaattcatctaagcccatgccgagtaataaggcagtcgctttgacatcgccagccaattcaccacacattccagtccatttgccttctgcgtgtgaagcgtcaattacttgtttgattaagttcaagacagatggggttaatgggttgtataggtgagcgataatttcattaccacgatctaccgctaaggtatattgcgttaaatcgttagtaccgatactgaagaaatctacttcttttgcaaggtgacgagcatttactgcagctgatggcgtttcgaccattacgccaatttgaagattttcatcaaaagctttgccttctgcactaagctgagctttaagttctgcaataatgccttttaattcacggatctcttccacagaaataatcatcgggaacatcaccgcaagtttaccaaatgcagaagctcttaatacagcacgcaattgagtatctaaaatttcacgacgtactaagccaatacgaactgcgcgccagcccaagaatgggttcatctcttttggtaattctaagtatggtagctctttatcaccgccgatgtccattgtacgaagcaccacgagcttaccattcattgcttcaacaatttctttataggcttggaactgttcttcttcaccaggtaactggttacgatccataaataaaaattcggtacggtataaaccaacgccttcgccaccgttacgcaacacgccatcaacatcacggatagtcccgatgtttccaactacttcaatgcggtgaccgtctaaggtttccgctggtaaatcttttaatttagctagttcagctttttcttctgcaattttggtttgtaatgcttttgctttttcaagttgttctgcagaaggattgatgtaaacttcattgttaatggcatcaagaattaaaatgtcacctgtattgactaatgaagtaatgttgtttgtacctacaacagcgggaagctctaacgaacgagccataatagaagtatgagatgtgcgaccgccaatatcagtaacaaagccaagcactttatctaagtttaattgtgcagtttcagatggagtgagatcgtaagcaacaaggatagcttcctcttggatatcaccaagatcaacaatattcatacctaaaatattacggatcaagcggttaccaatatcacgaatatcaccagtgcgctcttttaggtattcatcatcaatttccgcaagcatcgatgcctgcatatcaatgattttacttgcggcaacatcggcagttacaagattttcttcgatgtagcctagaatttcttcttctaattcttcatcttctaagatcattaaatgaccttcaaagatcgcttctttttcttcgcctaacgtgcgtcttgccttttctttaattgctgtaagttgtgctgctgctttttcacgtccagtaaaaaatttacttttttcagattcaatttgagtgggtgtaattttatgtgtgttaagaacaataggttcttctttcagaactaaggctttaccaaatacaatacctggggaagcggcaatacctgtgatcataaattaatcctcggctagaatttagtagatgctaaatagcacgaaagactttaccattgaataaaatggtaaagtcatcaatatcaaaaggacaactattctaaagtagggattaaatctactaagaaatctacagctttctgttcgtcttcgccttcagcagaaagagtgatgatagttccttgcgcaagacctagggtctgaagtttaaataaactttttgcactggcacttttaccattagatgtgacagtaatatctgaagcgaagccttttgctgcttttacaaattcagccgcggggcgtgtatgtaagccattcgggcaagtgattgttacatcttttgagtacattgttggttcctctgttgtatatcaaataataaatggaggactttttagggaagagcctccaaagtaagtcacgggattactttactacaaaatcggtataaaaacacgataaaagagattaaataaatgataaatgtcaattattagtgtgtattttaatcaatttataaaatcgtttgcgtattttatgaattatgtgttttattttcttttttatagaattattgattgcaattacccttaaaatcttgtatttatccatactttcaattcaaacacaacttcaactttttaggagcataaaatgcaaaatgtaggttttatcggatggcgtggtatggtggggtcggttctaatggatcgtatggttcaagagaacgactttgcgaacattaaccctgttttctttaccacatcacaagcgggtcaaaaagcccctgtttttgcaggcaaagaggctggtacattaaaagacgcttttgatattgcagaattacaaaaattagacattatcgtgacctgtcaaggcggcgattacaccaacgaagtctatccaaaattaaaagccacaggttggaatggttattggatcgatgctgcttctgcactgcgtatgcaagatgatgcgatcattgtgttagacccagtaaaccaacacgttattaccgaaggtttacaaaaaggcattaaaacctttgtgggcggaaactgtaccgtgagcttaatgttaatggcaatcggcggtttattcgagaaagatctcgtggaatgggtgtctgtggcaacttaccaagcggcttccggtgcaggtgcgaagaatatgcgtgaattgctagttcaaatgggtgaacttgaagattcagtaaaagcagaattggcagatcctgcttcatctattttagagatcgagcgtaaagtgactgcagaaatgcgttcagaagatttcccaacggcaaactttggtgcaccgcttgcaggtagcttaattccttggattgataaattattactggaaacaggacaaaccaaagaagagtggaaaggttacgcagaaaccaacaaaattttaggtttaagtgcaaatccaatcccagttgatggtttatgtgtgcgtatcggtgcattacgctgccacagccaagcgttcactatcaaactcaaaaaagatttaccattagcagaaattgaacaaatcattgcagctcacaatgaatgggtgaaagtcattccaaatgatcgtgaaacgacgttgcgtgaattaacaccagcgaaagtgactggtacattaactgttccagtgggtcgtttacgcaaactagcaatggggccagagtacttagcggcatttaccgttggtgaccaattattatggggtgcggcagagcctgttcgtcgtattttagtgcagttagttaaataatcttttcatctaatgatcaagcggtcagattattgcaaaatcctgatattatgtaacagttgcacagaggcttcatccgcttgatgaattaatttctgatacagtataatcgagtgaaacggcattgtgcttgcataatgtcgatagctgaagtgttgcaatcttttcatccaccaatgctaaatgttgtaacacttattttagttctcattgtaactcggtcagttttttcttaaatcaatgtaggttcaaagcaattttcaccgaaaaatatagtatctgactttaaatccacatcacatataacacaaaacttatcaaatagtttatatgatgccatttgtactcataaaacacaaaaaacagaaatgctaatggaagaatggcaagttttgtttagattatctgagtctgataaaggtcaaaatcaagatatagaaaaaagaagaaaaaaactatcggaaatatttagtgataacattaataataatgagaaagaatatctggctctctatgttcttcaaacatcttatgcgataattgtgaaattaatagcatgtaaagtcattcaaactctttcatttagtgaagatgttaagtttttctcagatcttagtattattgattctattaaattacaacgttttatggagaaacttgaagatggatatgttttttctagtggtggaattagaaacttactggaaggtgacttctattcttggtattcagataaaaaccaatggaacccaaaaatatataatagtataaaaaatataattaaagagttagagttttattcaagttcaaattttagttatgaatttcagacgatagatatttttaaagatttatatatggaaataatgcctaatgaaattaggcatagtttaggagaatatttcactccatcttggatggctgatcatgttgtatctcgttcacttgagaaactaaacaaagaatcttggaaagctatagatccatgttgtggaagtggggtatttttaatatcattaataaaatcgatactagataaacacgaattatatagtttaactataaaagaaaaacaagagttattattaagaatactatcaagtgtatatggtattgatttaaacccactatcagttttaactgcaagagttagttattttttggctataagaccattaattgacgaacaaaaaatagaaatccctgtctatcttggtgattcagctaatataccacaaaaaattgaactcgataatatagcttgttatacatataccgtagaaacaaaacaaggggattttaatattatttttccttgtaattttgttgaaagtagttctttttttgaaagaatgtatcgtttacaaacaacagtagaagctgaagaccctaaattattataccatcaaattattgaaaatatagatcaagagtttgtgtattgatagaaaattattctcaggtcaaagttatatgggagctatatcacttaatttatgtgctttaattgcaaatgttacatcagataaatggctaactaataaaggcttactagcattcttaatgccaaaaacaattatgactcaagattcttatgctggtttcagaaatttttatttatctgatggtagtcgaatgtatttaagtgaaatagatgattggtctaatgccggaaacccttttattgtaactaccggaaagtttatgacatatttttatgaaaaaaattctgtagattactcaaatgggatacctataaatttattctataaaaaatccaatgtgaaaatcacagaagtaaatagatttcatacatttgaaaaagtaaaagatttctttcaaattaaagatggaatggcttatcaattaagcgaaaatagaacgggatttactttactccctgaaagagattatacaattttaaggaagctaaagttaatttctggaacttcagattataaagctaggagtggtgttgagtttacgcctgctgaggtttacttcattgaacctgagaaaagaaccagtaaaaacactttttattttagaaactctgaattcaaaaattcagtttacaaagtggctaaaaactaaattcacattttaaatttatataaagtttggaggtgtttaagcgatttcaatgagccgccatttgaatgtgaactataagaccgattttgtcctttgccataaattacgtgaagtgccattcaaaactcgtgatttaagcccattacaaggtgaaatcctcgcagatggtgcctaggttaattttaattgtgcaacactaacttcgccaaaaatcgctataaatagtaacaaaaagccgataaacaatggcgaaaattcccaaagttcaggcagactaagcgttgtattatcagtctcaatcaacgagctttcaatgatgattgtggggtttaaatggaactattgtggcaatgaactatactgaaaatgccaaaacaattttagcattaaaccaccaattcgtgatacaaggtggtaatattatatgtgatgaaaatatggcgtatcaaacctatataccaaaaaacataggttaacctagtaaattctcatataatacaagcatctttaactatttatggactatttatgacaacatcatccccccttatagctattgtcgctggtgaaatttcaggcgatattttaggtgccggattgattaaagcactcaaagtacattatccaaatgctcgttttatcggcgttgctggtgagaaaatgttaaaagaagggtgtgaaaccctgtttgatatggaagaactggcggtgatggggcttgctgaggtagtgagacatcttcctcgtttacttaaaagacgtaaacaagtcattgacacaatgcttgcattaaaacctgatatttttatcgggattgatgcccctgattttaatcttggtgtagaagaaaagctgaaagcccaaggtattaaaaccattcactatgttagtccgtcagtgtgggcgtggcgacaaaatcgtgtacataaaattgctagtgcaaccgatcttgttttagcctttttaccttttgaaaaagccttttacgaccgttttaatgtcccttgtcgttttatcggtcacacaatggctgatgcgattgcgttgcaacctaatcgacaagaggcttgccgtttgttgcaattagatgaaaaccaacattatgtggcgattttggttggaagtcgtggaagtgaagtgaatttcctgtctgaaccatttttaaaaacggcacaattacttaaagctcaataccctgatgttcagtttttagtgccgttggttaatgaaaaacgtcgtgaacaatttgaagcgatcaaagcacaagttgctccagaattagaggtgataaccttagcaggcaatgctcgtgctgcgatgatggttgccgaagcaacattattagcatctggcactgctgctcttgaagcgatgttgtgtaaatcgccgatggttgtaggttataaaatgaagcctttaacctattggttagcaaaaagattggtaaaaaccgattatatctctctgccaaatttacttgcaaacgaaccgcttgtcccagagcttattcaagcggattgttcccctgaaaatttagcgaaacaccttagcctctatctatctcagatgcccgaagatgtggcgaagaagaatgcgttgaaacaacgttttatggaattacatcaatatattcaatgtgatgctgatgctcaagctgcacaagctgtggttgatgttttgaatagagagtaaaaacgggcaatttttgcccgttttatataacatcaataatctacgagtgatttttgatctgccccttctttctctaccacaggctgaatcatatgctcacgtttcaagcccaattcaagagcaacacctactgccacataaatggacgagtaagtaccgaaagcaataccgatcaataatgccagtgagaagctatgtaatgttggtccacctaatagataaagtgaaaataccacaaatagcgttgtaacagaggtcatcaatgttcttgataatgtttggctaagtgaaatatccacaatttcgactgaatttgcccgacgaattttcgggaagttttcacgaacacggtcaaacaccacgatactatcgttcaaagaataaccaacaacggataaaatcgcagccacgaaagtaagatcaatttcaatctgtaagaatgagaaaagaccaatagtcaccattacgtcgtggaacaaggctaaaatcccccctgttgctaaacgccattcaaagcgaagaccaacgtaaatcagcaacattgcaagggttgctaatgtgccgtaaatcgccccttgggttaattcttcaccgacatttggaccaacgaactcaatactttgaattttagcttctggatctaatttttggtgaattaaatccattaccgtattccccaaagatatatcgccagccgaagcaggtaggcggatcattacatctttttgtccaccaaaggtttgaactaaagcactggtataaccattttctgttaatacttcacgaacctttgccaaatctgcaggctgtgaaaagttggtttcaattactgtaccgccagtaaaatccaatccccagttaaaccctttagtcacaatggtaaacacacaaagtgccgtaatgatcaatgaaaatacatacgcaatgtagcggtatttcataaagggaactaatttataaggtagtttaatttctacttctttttctgttgtttgaacagtcatttaattccccttagatccaaagttttttcacacgtttaccaccgtaaacaaggttcactaacatacgagttcctgtaattgcggtgaacattgagatcattacccctaatgcaagagtcacagcgaagcctttgactggacctgttcctactgaataaagaataatcgcaactaatattgtggttaagttagagtcgaagatactggtgaatgcaccattatagccttcgtgaattgcctgctgaatagaacgaccattacgaatttcttctttaatccgttcataaatcaatacgttagcatcaattgacatacctacagctaacacaatccctgcaataccaggcattgttaatgtagctccgattaatgacatcaacccgatggttaaaactaagttagctaataaagcagctgtcgcaaataggccgaagactttgtagtacaccacgcagaataagatcgttagacctaaacctaacatacttgcgtccataccttgagcaacgttatctgcacctaatgaagccccgatagttcgttcttcaacaatcacaatcggtgcgatcaaagctccagaacgtagtaatacagcaaggttttgtgcttcagccgcactgttaatacctgtaatttggaatgagctacctaaacgagagttaatggttgcaacgttaatcacttcttcgtgtttttcaagaatcactttcccgtttgcatcacggcgacctgaatctttaaactcactataaagggttgccatcggcttacctacagcagattttgtcgcatttgacatcaaatccccgccttgtgcatcaagattaatactaacattaggcaaaccacgttcatctttgcccgaagttgcattaataatatgctcaccacctaaaatggttttgcgatataacaccgtcggcataccatcacgactatatttaatctccgaatctgcaggtacaataccacgagccgcagactctaagttagcattaccattgactaaacgaaattcaagagttgcagttgcccctaaaatctctttcgcacgagcggtatcttgcacacctggaagttcaacaacaatacgatctgccccttgacgttgaatagtcggctcagacacaccaagttcttccacacgcttacgcaaaatcgacaagttttgttcgatagctaaatcacgagaagttgctaacccctgagcagattgagcaaaacgcacaacggttggagaaatataagttgcttctaaattaggattagtacggcgaatataacgaactgctttatctgcagtatcggtatcattaaattctacatctgttgcaaaattttctgcttttttaaccgctttgtattgccatttttccttacgaaaatcgttacgcaaggtatcttgtagctgatcttgctgtttcgccaatgccgtattcatatccacttccattaagaagcgaacaccgccacgcaaatccaaaccacgcttcatcggctcaccaccgattgaagttagccattctggcgttgcaggcgcaaggtttaaagcgacagaataattattgcctaagacttcagcgattttttccttagctggaagctgttcctcgtccttatttaaacgcactaaaatcgaaccattttcaaggttcatcgccttaggcgtaatatttaatgaagcgagtgctgattgaacttgcgtcagcgtttcagctgaagcttgttgccctctagtaccggaaacctgtaccgaagggtcttcaccatataaatttggaagggcgtataaaatgccaatggcgaccacaaggatcaccattaggttcttccaaagagggaaacggtttaacacgataagtcccctttcttaaaggaaaaaattaaagagatttgagtgaaccttttggtaacactgcaactacgaaatcacgtttgatagttacttcggtagtatcgttcaatgcgatcacaacattgtcattatctgcagttactttagtaattttaccgattaacccaccgcttgttagcacttcatcaccttttgataaacctgctaataattcacgttgttgtttttgacgttttgcttgtggacgataaatcataaaatagaagataagaccgaaaacaaccaaaataaagatcatttccattccgccgccttgttgcatataaagctcctttaaaattattaactaaatttagacttcatctcaacattgagataatcactcactaaaataacataaaatctaccgtttaacgagtggaaattcagacaaatctactgatcggctttgtttctgttaagttttaggataatctcacaaaatattgtgtcaaatcattgaaattcaatcttaacaaggaaaaaagatgaaaaaaatcgtattacaagcggcagtatcttgcctatttcttacaaatgttgctttcgcccataatgtacaattaaaccaaacgttaccaagtgttaccgttcaacaagatggcgaattaattgccaatggtaaaaaagttgattatcgccaatggcaatcttcaagcctagctggaaaggtaagagtagttcaccaccttgctggcagaagtagtgtaaaagagaaaaatcaaccattaatggacgcaattaaaaatgcagggtttgatcgcagtaaataccaaaccacaaccattattaatgcagacgatgcgattgttgcaacgggagcatttgtcaaaaatagtgcagaaaacggtaaattggaaaaccctcactctcaagtcattcttgatcaaacaagtagtgtaaaaaatgcgtggaaactaaaagaaaaagagagttttattgcggtattggataaaaacggtaaagttcagtttgtttctgaagggaaattatctgatactcaaaaccaacaaattattgaattagtgaacagattaatttcccagtgatagataattccacaaatggagaaaaatggtgcaaatcgcttctagtgttacactacaagcgatttgttatttcaattgttttacgatttattttgtatccaattgtgggatcacattattctgaacagaaagcaaacctgcctgtgtataaatacctaatttaccacgcgtatccacaatgtctaaattacgcattgttaattgaccaatacgatctgctggggtaaacggtgcatcttctactttttccatacttaaacgttctggttcataggttaagtttggtgattcggtattcagaattgagtaatcattgccacgacgtaattctaaagtcactgtgcccgtaatcgctttcgccacccaacgttgtgctgtttcacgcaacattaaggcttgcggatcgaaccagcgaccttgatagagcaagcgacctaaacgtaacccattgatacggtactgttcaatcgtatcttcgttgtgaatacctgttactaaacgctcataggcaatatgtaataacgccattcctggtgcttcatagataccacgagattttgcttcgataatacggttttcgatttggtctgacattcctaaaccgtgacgaccaccaatgcggtttgcttcaagaataagctctactgcatcttcgatacgtttaccatttaatgcaacaggcacaccttcttcaaaggtcacagaaacgacttcaggcttgatttcaaccgtttcgtcccaaaatgctacgcccataataggtttaacgattttaatgcctgtgctaagtaactcaaggtctttagcttcgtgagttgcccctagcatattagagtcagttgaatatgctttttcaacggacattttatagtcaaagccatttgtaattaagaattgtgacatttctaaacggccaccaagttcgtcaataaaagtctgatctaaccacggcttatagattttgagttttggattagttaataaaccataacggtaaaaacgttcaatatcattgcctttaaaggtcgagccatctccccaaatattaacatcatcttctttcattgcagcaacaagcattgtccctgttacagcacgaccaagcggagtggtattaaaataaggcacgccacctgtcgaaatatggaatgcaccacattgaattgctgcaataccttcgtgagctaattgctggcgacaatcaattaaacgagcattctccgcaccgtattccattgcttttctagggatagcattgtaatcatcttcatctggttgccctaaatttgcggtataagcataaggcacggcacctttttgacgcatccaaagtaatgcggcactggtatctaacccgcccgaaaatgcaattcccactttttgaccaagtggaagcgtttctaaaattgttgctgacataaaacttcctaatattttttgaatgaaattaaaaaattctcgcaatcttaccgattgcgttcaaagttcgatattctaacgcaaaagtgaaacacaatctattcaaagaaaaagaatttataggtcacaaagaaaacggtaagatgtattatcttaccgcctataaaatgcattatattagctatttaaattataaatagaatttctcaacaaagtttaatttgtcatcaagtttcaacactaacggctgaccggttgggatttcaaaatccataatttcttcatcagaaataccgatgatatgttttgccaacgcacggagagagttaccgtgagcagtcacaagaacacgtttaccggataacaatgccggtgcgatttggtcttcccagaatggtaaaacacgctctagggtgatttttaggttctctgcatttggcacaacatcttttggaagatgtgcataacgacggtcgttatgtgctgaatttggatcttgcggatctaaatctggcggagaaatatcataagaacgacgccaaatatgaacttgctcgtcaccatactgctctgcggttgcttttttgtctaagccttgtaatgcgccatagtgacgctcgtttaaacgccagtttttcacttgtggaatccaaagttggttagattcttctaacacgatgttacaggttttgatcgcacgggttaaaacagaagtgaatgcgatatcaaattcataacctgcatcaagtaattttttacctgccgcttttgcttcttcaataccacgctctgttaagtttacatcacgccaacctgtaaataagtttttagcgttccactcactgaaaccgtgacgaataaatactaattccataagttctcctatataaaataaattgatttaatgtctatttataacaaaaaatactttttttttaaagttaaacacaattaatttgaagataaaaatgatctatgacaaaaaataagatgtaataatttattcctatgttggtaagaatgctactatttgcttattgcgagcataggatatttaaaatctgtctcacccgctccaaatcctccgccgtatccaccccaacttgaggggcttctttcgctaagtcgagatgaattttctcgccataccataatgctctaagttgctctagcgactctagctgttctaatgccgttggctcccaagccacatattgcttaacaaaacctgcacggtaagcatagattccgatatgacgaaggtagttttgttgttgaacaaaagcatcgtcacattgagggaaataatcacgtccaaaagggattgttgcacgagagaaatagagtgccattccgtttttatccgttaatgttttaaccacattgggattaaatagctcttctcgtgttgtcaatttaaccgcaagggttgccatattgacttgatgtttatctaaattttcagccacttgtgccacaatcaaaggcggaataagtggttcatcgccttgaatattcacgataatttcatcatctgcaatcgccattttttcaatcacttcggctaaacgttctgtgccagaattatgtttatctgacgtcaagcacacttctcctccaaaccttgtaacaacctgttcgatttcggggtgatcggtcgcgacgattacacgagtggctccagattgttgtgccttttcccaaacgtgttggatcatcggtttacctgcaatatctaacaggggcttatgcggtaaacgtgtagaggaataacgagcggggataatgacggtaaaactcataaaatctcctaaatgcgactaagatcaaatttcgctaaatcaatatgatttggcgtgccataaaattcacacaaggcttggcgaagttgttctgcacgttttggtaagcctttttctgcatagattttaacttgttcataaacggcttgtttgaaagcagaattatcgccagcatcgcccgttaagttatcaacactggcaaaataacggaaatttgctgccgtagctaacacccattcaatcgcttgcggttttacttcgacttgttcaaattctctttggcgttcagcagagcgtccatcgggttcataccagtaaccaaaatcttctaatttacggcgttctgttccagcaactaaccagtgagcaatttcgtgtaatgcactgctgtagtagccgtgagcaaataaaataacattataagggcgttcactcgctacgttaccttcatcaataaaagcggggagataaatcggataatctccgccccgctctaaacgagtgttgtaattttctacaaagcaagcgtcaaagatacgaataagatcttcataatcgtgatcgttttggttcattgtaaatcctatttgagataacttacaaaatcagtaatttcttctgttttgctagcggtggcaatgctatccccctcaagtggcgagccaaccagcagtaatgcgacaatttcatcgtcagcttgacaaccaaaggcctggcgtaaagcctgtcctttaatccacttattggtaatccagcaagtttcaaagccttgaacgttggctgcaagttgcattgcataggttgcacagcctgctgtaaccatttgctcccaagcgggtactttgggtaaatcttttgctattttagcgataatcccgataaccattggtgcgcgtttagctaatttttctgcttttgtaacaccttcatcacccatttcaagttcttgagcggtttctaacaggcaacgacggaaaatttccattgccgttggctcaatcactacgaaatgatagggctttaaacgcccgtgatctggcgctctaactgccgctttaaacatattttctagttgttctgcatttggtacatcttgaccaaattttttacttgaacggcgacgttgtagtaaatctaacgtttccattgagtattcctcgtgataaaaaatgggtcaaaggatagcatattttgtttcgctttattttgttgattgtagggaaacaaggaggattggctatttatttaaaataattttttagatttagcgatcctaaaattgtttgctgtacactagcagtttgagcacattattgtatagcttaatattgagcttcaaatatcgtaaacgtttgcttaagatccaattttcattatttgatcttgatcacattttttatgtgagattttccgcaagttattctaaaaatagtgtaaacttatcaagtttttcaggtgatgatatagggtgattttaatcatcgattagtcgtctaaacactattcatttttatattgattaattttaggagtcgaaaatggcagaacgtagagaacttgcaaatgctatccgttttttaagtatggacgcagtgcaaaaagcaaattcaggtcaccctggtgcgccaatgggtatggcggatactgcggaagtgttatggcgtgattttttatcacacaacccaaccaatccagcttgggcaaaccgtgaccgcttcatactttctaacggacacggctcaatgttgatttatagccttttacatttaacaggctacgctctttcaattgaagatttaaaacagtttcgtcaattacactctaaaacaccaggccacccagaatatggctatgcaccaggcgttgaaaccacaacaggtccgttaggtcaagggattactaatgcagtaggtatggcgattgcggaaaaaaccttagcggcacagtttaaccgtgaaggtcacgagattgtaaatcactacacttatgcgttcttaggtgacggctgtttaatggaggggatctcacacgaggcttgctcattagcaggaactttaggcttagggaaattaattgctttctacgatgacaacaatatttcgattgatggtcacgttgatggctggttctctgacgatactgcaatgcgttttgagtcttacggttggcaagttatccgcaatgttgatggacacaatgcggaacaaattaaatttgcaattgaaaatgcgaaagcagaaaaagatcgcccaaccttaattatctgtaaaaccattatcggttatggctcaccaaacaaatgtaactcgcacgattgtcacggtgcgccattaggtgatgcagaaattgcggctgcgcgtgaatacttaaaatgggaacacgcaccttttgttattccagctgaaatctatgcagaatgggacgcaaaagcaaaaggcttgctcgcagagaaagagtggaatgcaaaatttgcagcttatgcaaccgcttacccagagcttgccactgaatttaaacgccgtgttgcaggtgaattaccagcaaattgggcggcagaatcacaagcattcattgaaaaattacaagcaaacccagcaaatattgcaagccgtaaagcgtcgcaaaatgcgattgaagcctatgcacacattcttcctgaatttttaggcggctcggcagacttagcaagttcaaacttaactttatggtctggctcaaaaccaatccgtgcagattacaatgttgatggcaactatatcaactacggtgtgcgtgagtttggcatgtcagcgattatgaacggtattgctttacacggtggctttattccatacggtgcaaccttcttaatgtttatggaatatgcacacaatgcggtgcgtatggcggcattaatgaaacaacgttcattatttgtttacacccacgactctatcggcttaggtgaagatggcccaactcaccaaccagttgaacaaactgcggcattacgtttaattccaaatcttcaaacgtggcgaccgtgtgaccaagtggaatctgcggtagcgtggaaagcggctgttgaacgtaaagatggtccaagtgcattaattttcactcgtcaaaacctagctcaaatggaacgtactccagaacaacttgctaacgttgctcgcggtggttatatcctacgtcaatgttgcgaaaaaggcgattgcccagatttaattttaatcgcaacaggttcagaagtggaattagcaatgaaagcggcggacgtattaagtgcagaggggcataaagtccgtgtggtttcaatgccaagcactaacgtgtttgacgcacaagatgaagcttatcgtgaatcggtattaccaagctcagtaaccaaacgtgtggcgattgaagcgggtatttcagatttctggtataaatatgttggctttggcggtcgcattgttggtatgaatagcttcggtgaatcagcaccagcaggtgaattattcaaactcttcggctttactgtagataacgtggtagcaaaagcgaaagagattctgtaatcacatagaatgtggcaaaataaggggattttatatccccttattttttagtttctatttgggaaatcagaaaatgaagaaaattcttgttattcgtaacgataaaattggcgattttatgctggcttgggcggcatttgcgatgttgaaaaaatcaatgccgaattgccaaattattgcccttgttcctaaatatacagcgccattggcggaaatctgtccttatttagatggaatcattttcgatagttcagataaacaaaataaagctgaaaatgatcgtgtattacaagcggtaagatctgagcaatttgatgcagtgattagttttgtgtcggattggtataacgccaaattggtttggaaaagccgtattgtctaccgtttagcacccgcaacgaaactctttcaatttttatataatcaccgtttaacccagcgtcgctctcgttctgaaaaagcagagtatgaatataatgtagacttagtgcgttattttttgaaagataatcaaattacagcggtagagccgacgacaccttacttatcttttgataatgcttgtctgagtacgcaaaaaagcaaattaatggaactattaaagttagatggcaataaaaaatggctttttgtacatagtagtacaggaggatctgcgacgaatttatctttgaatcaatatgcggagttaattttagggattttagcgaaatttgattgccaagtgattttaaccgcagggccgaatgaaagcgaaactgctaaagcattgcaacagttagtaaatcataagaatgtggttatttatgataaaaatgatggattagtcgattttgccagatcgttagcctgtgctgatctctttattgcaggttcgacagggcctttacacatttgtggggcattaaatattgcaacggtaggtttttacccaagtcgtttatctgccattccacgccgttggaagccgttaaatgattccgataaacatatcgcattttgtccgccatctgataaggcttcgcaaaaaaatttaaccttaatttcgatggataaagcattaacggagattctgccgtttatgagacaaatcatggataataaaaaattataggatagtaagtagtaatatgttttagttattactagtaattaaatgttattaatatagtattttttattgttacaatctatctacttttgaattagagaggctacatgcaaaaaagaatttttaattttatccagaaaaaatatttatgtactataagttgtgcaaagaataatattccttggtctaatgcattttattatgtatttgatgaagataatctgcgtttaatttttgtgacgagtttaacgacttatcatagtcaagtgatgttagagaatcctaatatttctggtacaatctttgtaccaacgcgttttcatccctctttacaaggtgttcaatttacaggtaaagcaagaaaattagagggggatgaaaaaaatattgctagagaattatataaaaaagaatattcacatgaacttattgataaattgtctatttgggaagcaaaattagagtatgctagattaattgataattcattaggattatttagtgtaatagaatggaatggggaagaatatttctaatatatagtttttatactttcaacatcatagattcttttgagaaataaatttattagaacataacggtatgaatataaaaattcttattactggtggtgcaggttttattggatctgcaatgattaggtatattattaataatactcaagacttagtaattaatatagataaattaacttatgcaggtaatttaagctcattagaggagatttctaatagttctcgttatgcatttaaacaaatagatatttgcgataaaatagccttagagcagatatttaatgaatatcagccagacatagtaatgcatttagctgcagaaagccatgtagatcgttctattaagaattcggaagtatttattaagactaatatttggggaacttatactttattagaagtagctcgtaaatattggaatgatttgccagaggaaaaaaaatctatatttcgtttccatcatatttctactgacgaggtttatggtgatttaggaacaagtgagaggcagtttacagaaatcatgccttatgctccttctaacccctattcggcatcaaaagccgcaagcgatcatttagtgcatgcttggaggcgtacttatggggtaccaactatcgtaacaaattgctcaaataattatggtccctttcattttcctgaaaaattgattccattgatcatcttgaatgcaatagaaggaaagaaattaccaatctatggtaatgggttacaagttcgtgattggttatttgttgaagatcatgtgagagctttatataaggtaattaaagaaggtagagtgggagaaagttataatattggtggtgatagtacaaaaagtaatctggaggtggtttatgctatttgtgaaatattagaagaactacttccacataagccaaaaggggtacagaaatataaagatctaatttcttatgtaccggatcgtctagggcatgatactcgttatgctattgattcaactaaaattcgcgaagaattagattggaaacctcaagaaacttttgaaagtggaattcgtaagacagtagagtggtatttaaataatcaaaaatggtggaaaagcataagaaaaaaataatttttcgtattcttgttaaacaaaatagatattcattccttagcaacattctgaatgattaaacttaagaatacctttggttattttatcgctgtagagtgaatttgctaattactattttaacaaaagttattgaattttatcttctttcaaatacttatgttataaatgagtaagcctatctattagtggatcttcaaatataaaccctgcagattgtaatttgtgaggcacaagcggttgattatctaataacaattgcgaacgttcacctaataaccattttaagatccattcaggcacagtaaaaaaggctggacgtttaaggtgttgagccaatttttgattgagggcagaattagtcagtagatttggcgacaccaaattaaaagcaccactacattcgaaatgattgagtagaaataaaattgcccgaatttcatcatttagcgaaatccaagcccagtgctgtttaccggatcctagctttccccctaaaccgaaacgataaagcggtaacattttttgtaatgcaccgcctgttttgtctaatacaatgcccgtgcggataagacaaactcttgtcttattactctgagcttgtaaggcggtcttttcccattgaaaacagagctgagcaggaaaagctgtaccacaagcggtttgttcatcgtaatgttttccttccgccaaattgccataaaaacctgttgccgatcccgaaataaaagtgtgtgggggcgtgtcgctcgcttgaattagttcgactaaacgctgggttatgctaagacgactttgtattaatttttgtttctgtgttgtagtccaagctttgttaaaaatcggctcgccagcaagattgatcaccgcatcgaatgtatttaaatgctggaaagcggtaagatcttggcaaaaacttaccgcttgttgatgaggtagcctttggcgagtcagtacggttagctgatgtccttgcttgattaaagcctgacaaagtacttttccaataaagcctgttccgccagtaatcagtatattcattagagtgagctatcaaaaagttctgtaatagttgcaatcaatgttgaaatagaggtatcacgagttggggtaatgaaaatcgtatcatcgcctgcgatagtcccaagtatgccttctgcttttcccattgagtccagtaatcgagcgatcaactgtgcggcaccaggacttgtacgaacaacaatcaaactttcattatggtcgatatcgatcactaaatttcttagtgggcttgacgtggttggaataccgagttctgctggtaagtgataaaccatttccatttttgtatttcgggtgcggactgccccaaatttactcaacattcgggatacttttgattgattgatatgctcaaatcccatttcttgcagagcagtgacaatttcgctttgtgaaccaaatttttcttctcgtaataatgatttaaaagcttcgttgagagagtcgagtttttccacttattatccttttatttttatgcaattgtagccgtaaatatgcagaattgttgcctatttattcacggaaatcaatctaaactcactttttttctcgaaaatttgcggtaagtcgcaaaattgtattttggtatttgaaagttactatgaatttacatacactttcgctattaaatttacataacctatgaggagaaacttatgaaagttgcagtattaggcgcagcaggcggtatcggtcaagcattagctttattattaaagttacaacttccggctggcacaaacctcgcactttatgatattgcccctgttaccccaggtgttgcagttgatgtgagccatattccaacagccgtaaaagtggctggctatgcaggcgaagatccaacaccagctttagaaggtgcaaatttagttttaatttctgcaggtgtggcacgtaaacctggtatggatcgttctgatctgttcaatatcaatgcaggtattgtgcgtaacttaattgaaaaagtcgcaacggtttgtccgacggcttgtgtgggaattattactaacccagtaaataccacagtagctattgctgcagaagttttgaaaaaagctggcgtttacgataaacgtaaattattcggtgtgacatcactcgatgtattacgttcagaaacctttgtggctgaattaaaaggtaaagatgtcaatgatgttaaagtgcctgttattggtggtcactcaggcgtaaccatcctaccactactttctcaagcatttgaagaagataaaattgactttactgcagaagaagttgcagcattaaccaaacgtattcaaaatgctggtacggaagtggtggaagctaaagcaggtggcggatcagcgactttatctatggctcaagcggctgctcgctttgcacgttctgtgttaaaaggcttaacgggtgagcaggttgttgaatacgcttatgtcgaaggcaatggtgagtatgctcgtttcttcgcacaaccagtttgtttaggcttaaatggtgtagaagagttgttacctatcggtactttaagtgcttatgaggaagcagctgttcaagcgatgatcccaaccttaaaagcagatattgagttaggcgaaaaatttgtaaacggttagtcttgaatttatcgtaaaatcacgccatgatacaagggctggaaacttcagttttcagcctttttatatactactatggtgtactaatatggattatcttattaacgtcaataacactaattttagtgaagttattaaagctgcagcagaagtccctgtcgtttttcattttatttctccccgtgagcctcgttcacttgaggtggaggcttgttttcgtcgtttaaacgatgaatattcaaaacaatttctccttgctatcgtcaactgtgatgaatacccaatgattgccgcacaatttcgcatacaagcggtgcctacaagttatttctttgcaaatgggcaacctgttgatgtgattgagggtgagataaatgaacaagaattgcgagttcgtctaagcaacattttacccaaagaggaagaacttcaattcgctcaggcacttgaatttctagaagcagaacagtatgaacttgcgttaccgttattaaaaaatgcttgggaactgacgcataagaaaaacagtgattttgcgttactctatgcggaaacctatattacaatgaagcaagttgaaccagctaaagcaatcttgatgcaaattccaattcaagatagagatagccgttggcaaggtttgcaagatcaaattctattactagaacaagcggctaattccccagaaattcaacaactccaagctgattatactaagactaaaagtcctgagattgccgtaaaattggcaaatcagttacatcaagttggtaggaatgaagaagctctagaattattatatgattggttgaaacatgacctttcagcaggtaatggagaaattaaaaagcaatttctcgctattttatctgcaatggggaatgtcgctcctcttgttcctaaatatcgcagacaactttactctttattgtattagttttagtaagtgatttttcatatatttaggagaacaaaatggcaacaaaacacgcaaaattattgattttaggttctggccctgctggttacacagcggcagtttatgcggctcgtgcaaatttaaacccagtattagtaacgggaatgcaacagggcggacagctcactacaactacagagattgaaaactggcctggggaatttggcgatattacaggttcagagttgatgaacaaaatgcaaaagcacgctgagaagttcaacactgaaattatttttgaccatatcaacagcgtcgatctttcacaacgcccattcaccttaaaaggcgactttaatacctttacctgtgatgcgttaattatcgctacaggtgcatcagcgaaatacttaggcttgccttctgaagaggcttataaaggtcgaggcgtttcggcttgtgcaacctgtgatggtttcttttatcgtaataagccagtagcagtaattggcggcggaaatacggctgtggaagaagcgttatatctttcaaatgtagcctctgtggtacatctagtccatcgccgagatacttttcgcagtgaaaagattttaattgaccgcttgatgaaaaaagtcgaagaaggcaaggtgattttgcacacccacagtgttttagatgaagtgttaggcgataatatgggcgtaactggagtgcgtttaaaatgtactcaaacaggtaatgaagaacagattacgcttgacggcgtatttgtcgcgatcgggcattcaccaaatacggaaatttttaaagatcaactagagcttaacaatggttatattgtggttaagtcaggtttagatggcaatgcaaccgcaacaagcgttgcaggtgtattcgccgctggtgatgtgatggatcataactaccgccaagcgattacttcagctggaacaggctgtatggcagcgcttgatgcggagcattttttggaatattgctcataacttttgatatagtagacaaaatagttgctaatgtttgttttctttaaatattagcaaccttgtctattacatctagatcgtttgttcccagtattttcctcattgtagggagcaatatttcagtcacaattatttgttgtgctcaattttattaagataagaatatgtgttaagaggcagaaaagtaaagtgggtagaatccttcagttgattatttctgatatttattccacaaatcagcatacttcacaaaagtagaatgtgccgacagaacggcaagtaaaaaaccttgcttaccatcaagaaaacctgcttttaaaatatacatttttacaaaacagccgacagcgtgggtaacaccttggaataaagttgcttttttgccagctttggctctttgctctgaccaagccttagcgtaacttgctgattttactagataatggtgaatatctttataagtaaaatgcaataaatcgcctttaagtttagcgactttggcttcttttggataatggactttttcgtgaacaagttcatcgccgtattgagcaaaatccgtacggtaaagtctcactacataatcaggataccaccctgaatggcgaatttgcctgccaaaaacttcacttaaacggggaatttgataaaccgtgtttggttcattactacttaccgcttgttgtatgctctgttttaattctggggtgacacgttcgtcggcatccagccagaggacgtaatcgctggtgacatattgttgagcgagttggcgttgtttaccaaaaccttgccaatcggtattttcatagaattttgctccgtattgtaaggcgatttctttggtattgtcgctacttccagagtctagaatgatgatttcatccacccaacctttgatagtttctaaacattgggcaagatcttgcgattcgtttttgacgatcattgcgacgctaatcgttggcataggtcatcctttttgaaattaagtcagtttcgcctattttagcatatctttagctttaaaatttattctgaatatgctattttctacgccgatttttttagcatagaaaggcaattttaatgtcagtaaatttaacaacaaaacagaaacaatttttaaaggggcttgcccatcatttaagtccagtcgtgatgcttggtggtaatggtttaaccgaaggggtgttagccgagatcgaaaatgcgttagatcaccacgagttaattaaagtgaagatcgcaggggctgatcgtgagatgaagcagttgattattgatgcgattgtacgtgaaaccaaagcggtggaagtgcagaccattgggcatattttagtgctttatcgtcaaagtgaagagaagaaaatcagcttgccaaagatagctaggagcatttaatcaaatcttcaggaatagatgtttgtaagcacagtgatatattcatagggacagagaaattagttaatacttagaatgttgtatgaataatgaacaaaatataagcctgttactcaaacaaaattttgcatcaggattagtcgtttttcttgtcgcattgcctttgtgcttaggtattgcccttgcatcaggagcgccacctttagcggggattttatctggggttattggaagtgtcatcgttggcgcattaagttcttctcatattagtgtttctggacctgcagcggggttagcagcgattgtattagcagcgatgacagaattgggggctttcgagttatttttatgttctggtgtaattgctggtgcactgcaattgcttctgggttttcttcgagctgggagtatctcaaactatatacctatttctgtgattgaaggaatgctggcagggatcggtgtgattattatccttaaacagttaccttatgctcttggtagtgatgatacattaattgaaattgttcattctactggacgggttcatttagggtctttggttgttgcagtagttgcgcttattattatgattggttgggaacagcaacctcgattacgtcaactcaaattactcccttctgctttagttgccgttattgtggggattttacttaaccagcttttcatatggttcaacagcccgcttgcaattccaacaaatcaattagttcaactaccagtattaagctctttagatgaagtaagttccttaattcgctttcctagcttagagggtttcaataatagcatagtctggattacagggggaactattgcagtagttgcctctgtggaaacattactttcaattgaggctgcagatcgtttagatgttcgccgtcgaattacggataataatcatgagttacgagtacaaggttttgctaatatattaacctcttcgataggaggtttacctatgacatcggtcattgtgcgttcttctgctaatgcaaatgcaggagcgactcataaaacatctgcggtatttcatggtgttttgttgcttatgtgtattaactattccaagtgtgctcaaccagattccccttgcaacgctagcggcagtattaatattgattggatataaattgacacatcctaagcattataaacctttttggtgtaaggggagttatcaatttattcctttcgttgcaacaatggtttctgttgttttccttgatttgctgaaaggggtagggattggcttagtgattagtattctattcattctgtatggaaatatgaaaagagcttattacttgagccgtgaagaattagctgatgcggataagattatacttgagctaggtgaagaagtttcttttttgaataaggcagcgattaagaaaactttaaaaaatattcaacctaattcaaaagttacaattaatgccaagcgggctttatatattgcaagtgatgtattggaattactagaggactttaccaatgtatatgctcaagaaaataatattcaggttaaattgcgtggttttaaatatgactatgaacatcaggaagggagagagcatacacatattcgagttgagcatcgaagccggatttagccataaaggagtggtagaggaaatatagaccttagttcttattttgagcaattaatgtttttttctgtaaaaattataaaaagtacttgcgttagttttgaatttctctataatgcgcaccacacaacgacgcgctgttgtgagtagttaaatttgacagtgcgtcgttcttttttgctctttaacaatttatcagacaatctgtgtgggcacttgttgattgttgactttgtttaaaaatattttttaattttgaagtcttaataggtgcttaaactagaaattcatttttacttaaaagtaatatgtaaactttagctaagcagtttattgagcgattaaactttttaaattgaagagtttgatcatggctcagattgaacgctggcggcaggcttaacacatgcaagtcgaacggtagcaggaagaagcttgcttctttgctgacgagtggcggacgggtgagtaatgcttgggaatctggcttatggagggggataactacgggaaactgtagctaataccgcgtagtatcgggagatgaaagactgggaccgcaaggccagttgccataagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgatgaggaagggtggtgttttaatagagcactacattgacgttagtcacagaagaagcaccggctaactccgtgccagcagccgcggtaatacggagggtgcgagcgttaatcggaatgactgggcgtaaagggcacgcaggcggtgacttaagtgagatgtgaaagccccgagcttaacttgggaattgcatttcatactgggttgctagagtattttagggaggggtagaattccacgtgtagcggtgaaatgcgtagagatgtggaggaataccgaaggcgaaggcagccccttgggaaaatactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagaactcagagatgagtttatgccttcgggaacttagagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggtgcatacagagggtgacgaagccgcgaggtggagtgaatctcagaaagtgcatctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaactgaaagggggcgtttaccacggtatgattcatgactggggtgaagtcgtaacaaggtaaccgtaggggaacctgcggttggatcacctccttacctgaatgaagagatttgcaagtgttcacacagattgtttggtaattgtagacaagaaagagaacgaagacatccttttgggtctgtagctcaggtggttagagcgcacccctgataagggtgaggtcggtggttcaagtccactcagacccaccactctaaacggtgaagagaaatcgatactgaatagtgagtgaaacgaagaaagcgatgtgatgacattggggatatagctcagctgggagagcgcctgccttgcacgcaggaggtcagcggttcgatcccgcttatctccaccaatcatcatatttaagcgaacagtgagttgtttatttaaatatgatgattagccgaaaggtgattatcgattgttctttaaaaaattggaaacaagctgaaaactgagagattttctgtaggggcaaatcatatttgccctgaaacaagaaagtctgagtagtaagaaaatcttaactgaacaaaagcggttaagtgtttagtagttaatatcagtcttaaatgtttttttttagataaaaatgtttgaggttgtatagttaagtgactaagcgtacacggtggatgcctaggcaatcagaggcgaagaaggacgtgctaatctgcgaaaagcttggatgagttgataagaagcgtttaatccaagatatccgaatggggaaacccgatggatgaagaatccatcatttcattatgaatccatagtaatgaaaggcaaaccgggagaactgaaacatctaagtaccccgaggaaaagaaatcaaccgagattttgtaagtagcggcgagcgaaagcgaaagagccagtgagtgataacagcaaagacagaagaattggctgggaagccaagcgacacagggtgatagccccgtattcgaagtttttgttgtggtactaagcttgcaacaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagcccttttgggtgactgcgtaccttttgtataatgggtcagcgacttatattttgtagcgaggttaactgaataagggagccgaagggaaaccgagtcttaactgggcggatagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttatgtgaataccttcgggggtagagcactgtttcggctaggggtccatcccggattaccaacccgatgcaaactgcgaataccgaagagtaatgcataggagacacacggtgggtgctaacgtccatcgtggagagggaaacaacccagaccgccagctaaggtcccaaagtctatattaagtgggaaacgaagtgggaaggcttagacagctaggatgttggcttagaagcagccaccatttaaagaaagcgtaatagctcactagtcgagtcggcctgcgcggaagatgtaacggggctaaaatatagcaccgaagctgcggcatcaggcgtatcactaatacgccttacgattaacaacatcgaatgaagtgaaacggaatgagatgttggtcaagcaacccgaacgttgagtcggaaagtaatcgaagagaggattattagtgatacgtctgttgggtaggggagcgttgtgtaagcggatgaaggtgaatcgagaggtttgctggacgtatcacaagtgcgaatgctgacataagtaacgataaaacgagtgaaaaactcgttcgccggaagaccaagggttcctgtccaacgttaatcggggcagggtgagtcggcccctaaggcgaggctgaaaagcgtagtcgatgggaaacgggttaatattcccgtacttgtcttcattgcgatgtggggacggagaaggttaggttagcagactgttggatgtctgtttaagttggtaggtggggagcttaggcaaatccgggctcctattaacactgagagatgatgacgagtttctacggaaatgaagtaactgataccacgcttccaggaaaagccactaagcttcagatgaagataaaccgtactgaaaaccgacacaggtggtcaggtagagaatactcaggcgcttgagagaactcgggtgaaggaactaggcaaaatagcaccgtaacttcgggagaaggtgcgctggcgtaggttgtaggagtatacctccgaaggctgaaccagtcgaagataccagctggctgcaactgtttattaaaaacacagcactctgcaaacacgaaagtggacgtatagggtgtgatgcctgcccggtgctggaaggttaattgatggtgtaatcgaaagagaagctcctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctaagaagcagtcacgccagtgattgtggaggcgtccttgaaataccaccctttaacgtttgatgttctaacgaagattgcgaaacgcggtctcggacagtgtctggtgggtagtttgactggggcggtctcctcccaaagagtaacggaggagcacgaaggtttgctaatcacggtcggacatcgtgaggttagtgcaatggtataagcaagcttaactgcgagacagacaagtcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggagaattgagaggggctgctcctagtacgagaggaccggagtggacgcatcactggtgtaccagttgtctcgccagaggcactgctgggtagctaaatgcggaagagataagtgctgaaagcatctaagcacgaaactcgccttaagatgagttctcccacacaataagtgtgtaagggttgttggagactacgacgtagataggtctggtgtgtaagcggtgtgagccgttgagctaacagatactaattgcccgagaggcttaactatacaacctcaagcgtttttgaagtagacgtgagagagttagagagctgaataaaagcaacaaactaactaaacaaaataaaacaaagagactcagaacagcttgtttcgaataagaatagtgtaggggcaaattatatttgcccttaaagaacagaaaaaagaagatagagagaatcatcaaaagattttcccgacgacaatagtgcagttgtcccacctgattccataccgaactcagaagtgaaaagctgtaacgtcgatggtagtgtggggattccccatgtgagagtagagcatcgtcggggttttattaaagagaagaaaccgcaggttagagatagcctgcggttttttgttttctgtatacatatctgatttaattctccgcttttacttttttccaaaaaatgttaaattgatcacatttttaatccattgagataatcactgatgaaagagctgatcttacctaaaataagtcaaaacttagcaagctcatctcttttccaagatcaattatcttatataaaacatcgagttgatatgctcgatcagttccgtattcataacacgttacgcaatcattccgaagctttccaaagcgttttttcattattacccgctttattacactataatattccaagtttgcctgcgtatgttgaaaatgcgccaaaaggtatttttaatttcaacttatcggctactcagaaagctcatttgtctacttattttcccttgcctgaagatacaaaaaatattgcttttgatggtttgtatgtgatggggagcattgggtcaattacgcaaacctgtttatcagatttggatctctggctttgccattcgcaatcttttagttcagaagaatctgaattgctacagaagaaattgagtttaattcggcagtgggcaaaacagcaggggattgatgtcaatttttatttgatgaatccaaataggtttaaagcaaaaaactacaatagcgatgtgtgtgacgagcataatggctctgcacagcatttcttcttgcttgatgagttttatcgttcggcaattcgtttggcgggtaaacggattttatggctacatatgaataatggcgaacaggattatgagcaatatgttcagaaagcggtgagtttagggcaattaaatccagcggaatggatagactttggcgatttctctgcattagcgattgatgaatatttcggggcaagtctttggcaactttataaagggattgaaagtccttataagtctgcgattaaaattttattgttggaaagctatgcagaaacttaccctgaaacacaccttatttctaagaaattcaagcagttattgctttcaatagcagaagttcgctatcattttgatccgtatttggcgatgttagagcaagtaacaacatatttagaaaatcgtaaagagtttgttcgattagaccgcttgcgtagctgtttttatatcaaggcttatgatggtcagcacgatagctggcgtaaagaagcattgagagagttggtgacgcagtggcaatggagtgaacgtgaaatccaatgtttaaataattgccgtcagtggaaagtaaaaaaagcgatgacgcatcagcagatgattgttgaacagttattgcaaagttaccgtaatttaattcaatttgctcgcaaatttcatattgatcccagcattttgccacaggataccgacattttaatgcgtaaactctattccgcatttgaagtcgtgccaggtaaagtgcctttaatcaatcaaaatatcgctcgaaatttggctgaagatgaagtgactttcattgaagtcaatgaaggtgtttcaactaaagcaggctggtatctgatcaatcacgccccgttaagttcctatgactcaacaacccgtcacgttcagtatcaacgaacacttatcaaatcagtggcttgggcttattttaatcaagttattacagcctctacgcaaattcacttggtcagccaaagcctccagctttcaaccttacgtcaatttattacagatttacgcctttcatttcctgtcgcaacgccagcattgaaagatgatgatctttatcacccaaatgaaattcgtaacctgattgtcgcgattaatttaattcaagatcccacaaaagctctcccttccttgtctaaaatggagatggcacaactggatctatttaatttaggttcttctgagcaaggaatgattggtagtgttagcattatttatcgcaatatgtggaatgaaataatgacacagcactttgagggaaatgatgctattttgaaatccctcaagttaatttctaataaaatttatcgtaattctgccccgccacaatcggtaaatgtattttgttacagccatcagttaaaaaatgagttgcaaaatgcagtaatgagtttggtcaatcgttgcattaccgtacaaacaggctcaattttccaacgccagcaggcacaaacattcaaaatggcagggaaaaaatggcaactgatctttaataaacataataatttacaaaatattgttgccgatgaactcaacaatttgaacgatgagttgtcagagtttactggcaatattcctaaagagatttatgattttgccagtgaaggctttttacaatttttctttgatgataacaccgacggcagttttaatgtttatgtccttgataaaaataaccagactgaatgttattgcaactgtgttggggataaagaaaataaaatccgtcgcattagccgattttattcagacacggaaaatactaaagaaagccttaatagctttaattttcctcagttttatcagctattaaaacaaaatgatacaattaaaattgtaccctttaagagtaaacaacatcgagaatttttagaaccacattaaaaataggaaagtttatgtcctcaactttagctaaccccgaattaattaagacagtggtattacttgcaacaagtattactattgttccgctttttaaacgaattggactaggcagtgtattaggctacctcgtggcaggttgcttaattggtccttcaggtgcgggactattccaagatccaaatgcagttgtacatatggctgagcttggggtagtgatgttcttgtttattatcggcttggaaatgcaccctgagcgtttgtggagtatgcgtaaagcgattttcggtcgaggttttttacaggtcgctctatgtgggacattgctcacttttgcaggtatttttattctaggtttaccaaaagaagttgcgttcattgcaggaatgggctttacactctcttcgactgcgattgtaatgcaagtgcttgaagaaaaagggattagtaccacacctaaaggacagcgtatcgtttcgacattaatttttgaagatctagctattgtgccactattagcttctattgcatttttagcacctgaacaagctggagcagagcaagggacaaattggactgcgattggtgcgggcttagtgggagtgctgatcttagttgcttcaggtaaatggttaatgaacccgctgtttaagatgatttctaaagctcacattcgcgaaatgatgaccgcagcggcattattagtggtattaggttctgctttgttaatggaattgagtggtttatctatggcaatgggggcattcgttgcaggggttatgttgtctgaatcgtcgttccgtcatcagctagaggcagatattgaaccatttaggggtttattacttggtctattctttatgggcgtgggaatgtccctcgatctttctctcgtactaaataattggttatggctactgggtgtgatattactttatgtggtaggcaaagggttatctatttatgttgttgcattagtcacaaaattaactaaccgtgaagctattatgcgtacagcgattatgtcgcacggcggtgagtttgcgtttgtccttttttctgctgccgctaccgcaggtgtttttacagcagataatcaagcgactttcacagcagcagtgattgtatcaatgcttttatctccattggtggtgatcgtcattcaacgtttagtgaatttgaaagcgaaaaaatccacaggagaagctcagccaaatttagagggcattgaatttgcagaaaatttagaaagtagtgttcttgttattggctttggacgttttagccaaatcgtctgtcaagtattgttagctcgcggaattaatgtttcggtgattgattctgatgttgagaatatccgtatggcaacccgtttcggctttaaggtttactatggtgatggagcaagaattgacgtattaagagccagtggtatagcacaagcagactgtgtgattgttggtttagctgaacctgatcgcactttgcaaatactagaattgattaaacacgaatatccattagtgcctgtttttgctcgttcttacgaccgattaaatactgtgaatttaattaaacatcacgttgattaccaagtgcgtgaaacctttgaatctgctttattgctgagcaaggtgacccttgaacgattaggtgcaacagaaacagaagctcaagatgtaattaaccttgttcgccatttagatcaggagcgtttgaacgaagaagtgctacacggtttttccgatgaaattgcgaaaaaatattggcgagttgaacccttcgtaaaaccagcacacgaagcgacagctttaaatgaagaaactgcagatattttagaagaagttggcgaaagtattgaggtggttgaagttgaacttgatgatcagcgtgaaatggaaaagattaagttagcgactgatgaaaagaaagaagatgaattaagttaaaacaatttttagctatttgaaagttaaattactttataatttaactttaatatgaaatgtaagatagattaagacaatgattgaagctgacagaattatcagtgcctcagcaaagaaagaggatgaaactatcgatcgtgcaattcgccctaaaatgcttgccgattatgtcggacagccgtcagtgcgagagcagatggaaatttttatcaaggcggctaaattacgcaatgatgctttagatcacctgttgatctttgggccaccaggcttaggtaaaacgacactggcgaacattattgcaaacgaaatgggcgtgaatatccgcacgacatcagggccagtgctggaaaaagcaggggatcttgccgcaattctgacaaacctcgaaccctacgatgtgctttttattgacgaaattcaccgcttgtcgccagccattgaggaagtgttgtaccctgcaatggaagattatcagttggatattatgattggtgaaggcccagcggcacgttcaattaaactcgatcttcccccatttaccctcgttggggcaacaacacgagcaggttctttaacgtcgcctttgcgtgaccgctttggcattgtgcaacgcctggagttttattccgttgaagatctcacttcgattgtaagccgtagtgctggctgtttaaatttaaatcttgccaccaccgatgccgcttatgaaattgcacgccgttcacgcggaactcctcgtattgcaaaccgcttgttacgcagagtacgagattttgcagacgtacgaaacaacggcattatttcctctaacattgcaaaacaagcattaacgatgttagatgtcgattccgaaggctttgattttatggatagaaaattactttctgctgtaattgagcgatttgatggcggacccgttggattagataaccttgcagccgccattggcgaggaacgggaaaccattgaagatgtgctagagccttatttaatccaacaaggctttttgcaacgcaccccaagagggcgaatagccacatcgaggacttatagtcatttggggttggtaaaatctgaatagtgtaaatcggtagaatttttaaggttctaccgattgttttttgttttatccattgattttctttactcaagtcacatttttacaaataatttctgtaaaagtaacttaaaaactttacaaaactaattttttaagttactaattaataatttttaacacaactaaaaacggagattatttatgcaaacaacctttacccgttctttattagccagtgcgattgcgcttggtctttctgtttcggcttttgcagctaaagtacctgaaggtacggtgcttgcagagaagcaagaaattattattaataacagctcagaaccatcaagttttgaccctcataaaacagaaggtgtgccagaagctcaggtttcttatcagttacttgaaggcttagttaccaaagattctgcaggtgaaatcattcctggtgtggctgaaacctggaaaagttctgaagatttcaaaacgtggacctttaatttacgcaaaaatgcaaaatggtctaacggtgaacctgtgactgctcacgattttgagttttcgcttaaacgtttaggcgatccaaaaaccgcttccccttattctagttatttaaactatcttcaagttgaaaatgcccaagagatcattgatggtaaaaaagcaccgagtgagttaggggttaaagctgttgatgattacactttagagatcaaattaagcaatccagtgccttatttagtcggtatgatgacgcaccaaacgatgttgcctgtaccaaaagcagtcgttgagaagttaggtgatgcttgggtgaaaaaagagaactatgtgggtaacggcgcttataaattagtagaacacgttattaatgaaaaaatcgtgtttgaacgtaacccattgtattggaatgataaagaaaccgtgattaataaagcgacattcttagccattccaaatgcaagtaccgatgttcaacgttatcgtgctggcgatttacatattacaaaccatgaattaccgccagaacagttcccgacacttaagaaagaaattccaaatgaagtctttgtgacgcgtacgctttcaacctactactacgagccaaacaatgagaaagctccatttaatgatgtgcgtgtgcgtaaggcgttaaaccttgcattagatcgtaacgtgattacggataaggttttaggacaaggtcaaaccccaacctatgtgtttactccgccgtacattaccgaaggtcacttaattcaacaacctgagtattcaaaacaggatatggcatctcgtaaagcagaagcgattaagttgttagaagaagctggctttagcaaagcgaacccgcttaaatttacgcttttatataacactaacgagaaccataaaaaaattgcgattgcagcacagtcgatcttaaaacaaaacacaggcggtttagttgatattaaacttgaaaaccaagagtggaaaaccttcttagatacacgccgtgcaggtaactatgatgtggcgcgtgcaggttgggcggctgactataaccaagcatcgactttcggtaagtacttcttgtctaactcaagtaacaacaccgctcgttataagagcgcggcttatgatgctgaaatcaatgcggcataccaagcaggcaatgcggaagagcgtgcggcagcttatgcaaaagcagaagctcagttagcgaaagattatgcaatcattcctatttataactatgtaaacccacgtttagttaagccattcgtgaaaggttatgagggtaaagatccgcaagataatattttattaagaaacctttatatcattaagcagtaacttttaagcggtgcgattttttaaaatctttgcaaattttgccaaaaatcgctccgcttgttttcttttgttgtgcggatcggagaattgagcaatgttgaaatttataataaaaaggattttagaagcgattccaacgctttttattttaatcacattttcgttttttctaatgcggttagcaccaggtagcccatttacctctgagcgtgcttatccacctgaagtgatagcaaatattgaagccaaatatcacttaaatgaacccttatataaacagtattttatctaccttgagaacttagctcagggggattttggtccttcttttaaatataaagatcaaaccgttaatgatttaattgcttctgcttttcctgtttcatttaaactggggattgttgctttttgctttgcggtaactcttggcttgctggcaggaacggtggcagccttgaagcaaaatagtaggtgggactactttataatgtcctttgcgatgacggggattattatgccgagcttcgtctttgcccctcttttagtgttaatttttgccatttatctcaaatggctacccgctggcggttggaatggcggtcagctctattatatggtgttacctgttttatcgcttaccattgcctatgtcgcagggattgcgcgtattacgcgcggttcaatgattgaagtgctacattctaattttattcgtactgcacgagctaaaggcttgccgatgggtaagatcatttttaaacacgctttacgcccagctatgttacctgtgattagctatcttgcccctgcgtttgtggggattattacaggatcaatggtaatcgaaagtgtctttggtttacctggtatcggacagcttttcgtcaatggggcattaaaccgtgactattcccttgtgttaagtttaacgattttggtcggcacattaaccattttctttaatgcggtggttgatattctttatgctgtgattgacccgaaaattcgttattcataaggagtgtgagatgttaattaataataagaaaaatcaagaacttgcagaaaaattagcggaacagaccgctgacatcgccgtggaaggtcgcagtttatggcaagatgctcgtcgtcgctttttccgtaataaagcggcggtaagtagtctgatcattctcttttttgtggtgttattcatcacttttgcaccgatgttaatgccatttagctatgaagatacagattggaatatgatgagtgccgcccctgattttgcatcaggacattattttggtactgatgcttctggtcgtgacttgttggtacgaattgcaataggcggacgaatttcgctgatggttgggattgcaggggcattgattgccgttgtcattggcacaacctatggggcaatttcgggctatgtgggcggcaaagtcgatatggtgatgatgcgtttgctcgaaattttaggctcgttcccatttatgttctttgtgattttattggtgacattcttcggtcaaaacattctgttaattttcgtggcaatcggtatgattgcgtggttaagccttgctcgtatcgtgcgaggacaaaccctcagcttaaaaaacaaagagtttattgaagcggcgattgtctgcggtgtgccgaaacgccagatcatctggaagcacattatcccgaatgtattaggtatcgtggttgtttatgcttcccttgaagtgccagcattaatactctttgagtcctttttaagtttcttaggtttaggcacacaagagccgatgagcagttggggagctttattaagcgatggtgccgctcaaatggaaacatcaccgtggttattggcattcccagcctttttcctctgtttaaccttgttctgttttaactttattggcgatggtttgcgtgatgccctcgatccgaaagacaaataggaagttgcacaatgaaattattagaagtcaataatttagatgtctatcttaaaaccgatgaagaattggtacacgcagtgcgttcggtttctttcagtgtggaaaaaggacaaactttagcgattgtcggcgagtcaggatcagggaaatcggtcacttcaatgtcgataatgcaattgttgccacataacattgttacctatggcgaaaattcttcgattatttttgaagggcaagatattttacgtttctcagataagcagatgcaatcattgcgaggtgatcgtatcggtatgattttccaagagccgatgacctctcttaacccatttatgcggattggggaacaggttgccgaagcggtgagtacccataatccactgttgagcaaacagcaggctcacgaaaaagcattagcgatgttacagaaagtgaaaatcccagatgctgagaaaaaaatggtctgctatcctcacgagttttcaggcggacagttgcaacgcataatgattgcaatggcgatcatcaataaacctgacttattgattgcagatgaaccaaccactgcccttgacgtaactactcaagcggaaattttagacttaatgcacgatctgcaagcagatatgggaatggcgatcattttgatttcccacgatcttcgtttagtgcataaatacagtgacgatgtatgtgtaatgcaaaatggcgaaatcattgagcgagggaacacagaagaggtctttaaaaatcctcagcacccttacaccattgaattgctaacgccgatcccaagtgatctaaaacatcaagttgcagaaaatgccccacaactgatcacgacagagaacgtggatatagattacattttaaaacgcaatctatttggcaaaccgaccaaagtgtttaacgccgtgaaaaatatttcactcgatctgaaagtaggcgaaactttagggatcgtgggcgagtcggggtcgggcaaatcgacactcgggcgagcgattatgcagatcttagcctatcgaggaaaaattgcctttgcagatcaagagatcgccgcattatctaacgaacagcgtcaagccttgaagaaagatatgcaaatggtattccaagatccgtttaactcactctctccacgcttgacagtcggtgagatcgtcggcgaaggcttatccgtgcattatccacaaatgagcaaagaagagcgtcgtcaaaaagtgatgaaaactttggaagaagttaatctttcgccatcaatgatcaatcgttatccccacgagttttcaggcggacaacgccaacggattgcgattgccagagcgattattcttgagccacaattcgtcttacttgatgagccaacctcagcccttgaccgttcaacacaattaacggtggtagaattactgaataacctccaacgcaaatatggcttaagttacatctttatcagccacgatttagcggtggtaagagcattgagtaacagagtaattgtgatgagcaaaggggaagtggtagagcagggcgaagccaaacagatcttcgagcaaccaaaagacgagtacaccaagcggttaattgaagcgtcgaatttgtaaatcagcaaggcatagtagagaacaggggaatttatctttttctactatgccccaagttttaggtaactgtattaacaaataccattcttaatattctcaagctcttcccaacgctcaaacgcttgctctaacgccatttccgtatccgctaatttttgtaactgagcttgagtatagctcggatctttagcaaagaaatccgcactattcacttcggcttgtaaggcttcaatttctgcttcaagctgttccattttttcaggcagggcttctaactctcgttgttctttataagaaagtttgaccttctttccctccccctgcttgcggggggaggtgtccgcaggacggaggggggcattctcgctttctacaagcggtgctttctcaacgtttttttgcaaattcccattgccctctccctgattgcggggggaggtgtccgaaggacggaggggagcttttgaggcaaaataattagcctgttgttgcttcgcatcgtggtagccaccgatatatttattcacaaccccttcgccttcaaagatgtagcattccgttgcagtattgtcgataaattgacgatcgtggctgacaataatcaaagtgccttgataatccgccaacatctcttccagtagctctaaggtttctacatcaagatcgttggtgggttcgtccaaaatcagtaagttatttggtttcaacaataatttagctaataacaagcggttacgctcaccgcccgataacgctttgactggagtcatcgctcgttttggtggaaataagaaatcttgcaaatagccaagaacgtggcgttttaccccattgacttcaatatcttgcttaccgtccgctacgttgtccatcaccgtcttttcaggatcaagctctgctcggtattgatcgaaataggcaacttctagtttggttccgcaacgtactgttcctgctgtcggttgaatttcgccaagcaataacttaatcaacgtcgttttaccgatcccgtttgcaccgataaaggcaattttatcgccacgcaaaatcgtagtgctgaagtttttcagcaaggttttgcctgccacttcgtagctggaattttccacttcaaatacaattttgcctgaacgagcggtctgatcgagctgaatttttaccgtgccttgtacttctcggcgtgctttacgctcttctcgcaaggctttcaaggctcgcacacgtccttcattacgagtgcgacgagctttaatcccttggcggatccaaacttcttcttgggctaattttttatcaaacagctcattttgtaaggcttctacacgcaagtcttcggctttagtttcaaggtaaacatcgtaattacttggataggaaaccagtttgccccgatctaaatcgacaatgcgagttgccattttgcgaataaaagcacggtcgtgagagatgaaaataatactgcctttaaactctaacaacagattttctaaccaagcaatcgtatccacatctaaatggttggtcggttcgtccaacagcaacacatcaggatccgccaccaacgcacgtgccaacgccgcacggcgaacccaaccgcccgacagctcacacaaccgtttttcaggatcaagctctaatagtttcaaggtatcttgaatacggttttcaaactgccagccgttagcgtgttccagttgagcctgaacttgcgaaagttgcgacatcagcgtatcgctgtaatctgtcagcatttgttgcgaaatgtggtgatattgctttaaaagatcggctaaatgtgcgatcccttctgcgacataatcaaaaacagtatcttcaatatgttggggcggatcttgttctaaacgggtgacaacaatatctttttcaaaaatcaatttgccatcgtctaactgaacttcgccagccagcactttcattaaggtcgatttgcctgccccgtttcgtccgacaagacagacacgttcgccctgttcaatgtgtaattcagtgtgatcaagtagtggatgatcgccaaagcctaagtaggcgttagaaaggttaattaaagccatagaatatctgttgaaataaaaatttcgcaaattttagcagttttcctaccgcttgtaagtgatttaataaagtgaagtaatgaaagtataaaagtggtttgagattgcattaaacttagtgagattgtactgatttgggaggtaatggaaagagaagctattactgcccataggtaatactgttctttttgtgtatgaagtttattacaaaatttgctacaatccattcccatcatagatacggaggcaaaatgcaagttgttacaaagctcatacctaccaaactgatttccagtaaatctacacaaaacacacgttcagcaaatcaaaatattgaacgcagtgagcttttaaaaaaacttgccgatgttccgcactaccctttaactgtcgtgattgcccctgctggctatggcaaaacgacattaatttcccaatggaaagaacgcttattagcgaaaaatgagcaagtcgcttggtttgctttagatgaaagcgataataacgctgaacagttttgtcactatttttcatcggcattaaccaaagccacaggcatttcactgcaagggataacctataaaaataacttggtggattactttggtcagctcttggtcttactggataatgttccccgtcggttttatctgattattgacgattaccacctaattgataatcccgaaatccacgatgccctgcgtttttggttgaaacatcaacccgatacaatgagcctagtgctactttctcgccttacgccaccattaagcattaccaacttgcgtattcacgaaaaactgctcgaaattgacgtgcatcagctagcctttaccccagcagaaacccgtcaattttttgaacaaaaactcaatgaaacattgagtgacgaagtgatttttgcgttatgtgaacgtgtggaaggctgggcaacggcattgcaactgatgatctttgccattaaacaaaatgctgaactgttacatttccctgaaaaattactgaccaagctcaatcagcaacatattgctgactatcttaacgaagaagtttttcattatgtcgatcctgacatcaaacgctttatgcaacgttgtgcgattttacgttcaatgaatgaaaagttggttgtagctcttactcaagatgaaaatggggtcaagcggttagatgagctagaaaaattgggattgttcatcacacgaatgacccacgatgatgacgagaactggtggaaatttcacccgattttagctgcctatctctcacaaagttgtcgcttggaattaccaaatgaatggcaacagctacaccaaactgccgcaatgatgtggctaaaactgggctatggctcagaagctctctaccacgctcaaatgctagatgatccacaaacgctctaccaaatactgcaagaacacggctgggcattattccatcaagggcaactcaaattattggaagactgtttaagccacttgccatcagaacagatatggcaaaatgaaaatcttgttctgcttaaagcgtggttagcacaaagtcagcaccgtcaccaagaagtaagcggtattttgcaaaaattccaaccaaagttaccgcttactgagagtttgcaagggcgttttgacgcattaaaagcccaagtggcaatcaatgctggcgacgaagaacaagcctatttaattgccaaccaagccttagctaatttgtctgatgaatttgattatgcccaaattgtggcgaaatccgtgattggtgaagctcaacattgtcgtggttatctcaaagaaagtttagccttaatgcaacaagttgaaaaaatggcaaccagtcagcgagcgtatcaccactggctttggtctaaattacaacagtctgaaatcctatcggcacaaggcttttggcaatccgcctatgatttattaaaagaaaccaccttacaaaccaaagaatttcatcaaattccgatgaatgaatttttgctacgcttaaaagggcaaattttatgggaatggcaccatcttgaccaagctgaagcaatggcgaatgccggtattgaagtgttagaaaaagaagaagaacgcattcaaagccttgccttattagccaaaatttccctaaccaaaggggatttaaacaacgcagaacgtctaattgagcagtgccgaatgctactggctcgttgttcgccccataaagactgggtaacagcacttgatgaaatccaactgatctattggcaaatgcggaatgaaactcgctatttagaaggctggctggctcaagccaatttccctagccaagagcataaccactttacccaacgccaatggcgaaatatcgcccgttgttacctgctacaagaagattacgaacaagcattgcgtattctcaacagtttactgcgtaccacagcgatttttaatttagtgagcgatagccaacgtgcgttaattttgcgtaatcgagtttacactttacaaggcaagcctgatttagctcaaagagatctcattcaagccctaaatttaagccaacagaccaactttatcagtgcatttgtgattgaaggcgaaataatggcacagcaaattcgccagctacttcaacttaatgtattagaagaactttcaacccataaagcccaatttattttgcgtagtattaaccagcataaccgccataaaacagcacattttgatgaagagtttgtcaaaaacttacttgctaaccgacaagtgccagaactgctcaaaatcagcccgcttactcaacgagaatggcaagtgttagggttaatttattcaggttacagcaacgaacagatctctcaagaactggtcgttgcaatgaccaccattaaaacccatatacgcaatctctaccagaaaatcggcgtggcaaatcgtgctgaggcgattgaatatactcgcagtttgttgcgaatgatggggtatatctagataaagtagaaaatcaacaatcaatttagaatctattcttcatatatatttctttttatttaagttgttttagtgtaaagtttggatgtatatgaatgtggatattattttatacaataatattttctattaatctaattaatgtttattggtaaatcactattatgattttttcaaatgtgatttgatataagagagaaatataatggctaatttgtcccctgatgaagcaattgagcttgcatatgatatttttttagaaatggcttcagataatttagagcctgcagatattttactttttaatttgcaatttgaagaacgtggagcggtggaaatggttgaaactagtgaaaattgggagcaagaaatcggtgttttaattgatccagatgcttttgctgaagtttggattggtttgataaatcagaatgatgagatggatgatatttttgcacgttttttaatttccaatgatgctgagaatagagaatatcatgtaatttggaagagttagaggatgtaattgaggggacggagtcaaggtaacattaatttattttagtctaatctttttaatctggatataataaaggcagcttttgagaagctgcctttatagtcattatttttcgatctcttgtggcaacgccaacactgtttccactggtttggcttcgacattgacctctttcagatcttcttgttttaatctattcgctaattcgacatcgtgggtctgctctgcgacatacagtgccataatgcgatctttcgcgatacactctttatgctcaagcagttgcacaaagtaaggtttcgctttgtcgaaatgtcctgctctggtgtggatataacctagtacacgcgcgtaatcgtcactgtaacgctcttccgctttgctgttgcgttttaagagaactttgaatagtttatgttcttcatcaacttgtaagcgtgttaattctggatagagcaacacaagttgttcatcttgatattttttcacagtttcaagagcgatttcttgagcagactcgtgatcgtctgtgtcaattaagcgtttaatcaagccaacgcgaacgtaaatagaacgacggcggcggcttggttgattatcccaccattttaataagccttcttgaccttcttcattcataatttcatctaataagccgtcattgacttgctgttcaagtctttcgtactcttctgccgataagaaactacgttgtccgatttgttctaatacgtcatcgagtgctttgtaagccttcgatttttggtagatttcaatcgcaaggcgtaaggcttcaacgttgtttggagcaaggactaataagctatcgaccgcactgcgtgccgcagggagtttgccttgtagcagtaaaattcgtgtgcgagcaatttcaacggcaacgttgtttgggccagcgattttagcagcttcaattaaatacttgttcgcattgagttcgtcgcctcgttgttgagcagcttcggcagctttgatgaagtttaacactggctcggcggcgtgttttgcattttttgcaattaatctctccgctttagagtaatccccttcggtcattttcattaagcctttgagggtttgctgttgtgcttttttacgtttgcgatcgccaaaccattgataagcacctcgacttaacccaaagaaacggcggacaatccactctattgcataaaccactgccatagctaccgcaaaaaagaccacgagcattactaggctcatttcaatcactttgcctgcggtttcaatgcgtacataaccttgatgccccgaaatataaggccctaaaattaagcctgcaaggacaattagcattaaaaagagaacgcgaaacataatctatctcctattgttgctctgtagcaggttttgcttcggttggtgtttcttgagctggtgttgcttgctcaagggatttgtcttgttccaactgaattttgctaatcggtttaggggctttattgagcagttgatctaataagcctaaactgtgcaggcgatttggtgcgtcaatgtagatagattgttcaatcatctcgtcaatttcttttaagaaggttttgacttgttcattctgcacatcaaagtaacttctcacccaagtgctaactgcttcaagcgattgtttatagagttcattttgctgacgtgggattgccaaaatcgcaatttgtaaacgtaagcggatattttctcgtaagtaaatctcttgatttggtgcaacaaaagctttctcttttgccgtcgctttatcgctaatgcggataaagtgatttaagaaagagttcgcacttttttctaggttttgttgccagtcttgcactgagttactcacttcgcctgtggcaacactttcttcttccgccgtgttgtcgatcatcggcatatcatcaagcaaattcgctaattgcgttaatcgttgcattaaattgttttgatcaacattgtttacactagcaagttggctgaggtcttgtttaatcgcttcacgaatgttaagaactcgattatcgctcacttggcttaatacgttatccgcttcaataagcaagctacgagccgtatcaatatcgttatctaacactactttgcgtaaggcattgttaagtaagaaatcagcgtcagataatagccattcactttggtctgcttttggtgtcgcccctaatttttgaatttggctttgtagggcgttgatttgctgagtataagccgtttgtgcattctctaactgtgcaattttatctaatgattgttgataatcttgagtaagtttggcaattttgactttttcttcatcaaagttagggatttcagcaactgtttgttcgggttgattttgggttgcttttgcttgtaatgcttgaatttgtgtatcaagttgagcaaatttttggttgccgaagaaataccctgttgcccccacgcctaaggcaatcaagatagacagcagagagagtgcttttccccctgatgattgttttggttgttctgattgaataggttgagcaatttccacttgtttttcctcttcttcagtttttggatcaatagcggtgacttcctctgtctcttttaccatttctggctcagagactaccgcttgttctacatcgactttcacatcttcagtcacgactggctcaaggttttctgcaacgttttctgttgcttcaaccgcttttggctttttgctctgtttcgacataatgttcacctattttagttaaaatttcccacagttgagtattgtttccagcagactatgattatccgctttcattgaaatttgaatttgttcgcttttccagcctgattttcgggcaagtgtggcgatacgtttgccaaccacaattaaacgacattggtagagccaaggcagatccgcttctgcggtctgttcgataaacgtggttaaaatctcaccgcttgtcacgacaatggtatctgttcctgctcgttttgcgaggcttatctgttcgcttaaattatccgccaacattatacggcgataacattcgaggatctgcacttcagcacctcgtgaagttgcctgttcagcaaaaaattctcgccctgtatctgcgcgtaaaatcagcacattttttccagacaactgagccatttcaggcagtgccagtagcccttcactgttttctgattgaatagggtaacgtaccgcttgttcaatttgggaagcgaaatggtttgccgaacgttgtccaacggcaaaatagagtaaatcacttcgccagtgaaatcccgtttgctttaaggtttcagttgcaaaattaacggcattttttgacacggcaaaaacataatcccccgaatttaaacgagataaactgcttggcaaagtcggtaaatccgcccctgcttcaacttgaaacagcggttgatgaatggcaaaaatttgctgttctgccaacatttcaactaattgttgccctcgttgatcgggacgtgtaactaaaacattcatactattcactttgataaacggtttttaaaatgtgatcagccccttttgcaagtaacgcttctgccacttcaacacctaatttctctgcctcttttatgttgccttttgctgacgctcttacaatggttgaaccgtctaatgaaccgacgagggcatttaattcaatttcatcacctgttaatgttgcaaaaccgccaataggcacttggcaaccgccttgtaaacggctgttcattgctcgctctgcttgtacacagtaagcggtcggttggtgatttaactctgcaagataggctaacactcgctcgtcattcaaacgggtttcaatcccaactgccccttgcccacaggctggtagtgatgtttctacagggataaaggtgcggatacgttcgcttaagcctaagcggattaagcctgctgaagctaaaataatcgcatcatattcaccattatctaatttgctcaggcgagttccgacgttgcctcgtaaggatttgatctgtaaatgcggatattttgccattagctgacattgacggcgtaggcttgatgtccccacaacagcccctgctggtaaggcttcaaggtttgcatagtgattagatacaaacgcatctcttggatcttcacgctcacaaatgaccgcaagccctagcccttcaggaaaagtcatcggtacatctttcattgaatggacggcaatatctgctcggttttcgagtaaggctaactctaactctttgacaaataagccctttccaccgatttttgctaacggtgtatctaaaatgatgtcgccttttgttaccattgtaaccagctcgactgataattgtggaaaacgctgttctaatgcgtctttaacgaaatttgcctgccaaagtgctagaggactttgacgagtagcaatgcgtaaaatctctttcattcgtttacttttctttaaataaagatagccgttatcctaccactatttgccctttcttgccaaaaaaattgaacagtgatcttgacgacaataaaagaaacattaaaattcgcaacgctttaaaaaagcagttcggatgaagatagctggagagtggggaataaccctacaccgacgaggtaaaatctttcaggtgcgacagcgaggacagctattggacgaacccttggagagatccactctgcatagcagaaaatggacgccgaaggcgaaagcaatgaatgcgaaacgctcaggcaaaaggacaggggagaaaagtaaccatcatttcaagcggtgggattatattcattgcttttgtgtgaaacagcatggtgtccctacagaatgcaaaaaattcatcacatcattccgcttgtcttattgcttttctttccttgtaagttatttttacgaggaattatttatgtcaattgacaccattcttagctcaataaatagtatcgtttggggaccaccactgttgttattagtttcaggtgtggggatctacttcacccttaaacttaaattactgcaatttttccacttacctagagccttttcttatatgttcaaatcagaaaaaggcgataatcaatcaggggatatttctgctttaggtgcattagccactgcacttgccgccactatcggcacaggtaatatcgtcggggtcgccaccgctattcaagctggagggccaggggcaattttctggatgtggctcattgccctgtttggtatggcaactaaatatgccgaatgtttattggcggtgaaatttagaggcaaagataaagacggctatatcgctggcggaccgatgtactatatcgaaatgggtatggggcagaaatggaaatggctggcaaaactgtttgcgatatttggggtaatggtggctctctttggtattggtactttccctcaggtcaatggaattaccacatcattgcaagatacgttcaacattccgattagcattaccgccgttatcttaacgcttaccgttgcggcaattacgctcggcggtgtaaaacgtatctcaaaaatttcaatggtgatcgtgccttttatggcggttagctatgttggggcttccctgctgattttagtgcttcacgccgataaggtgccagacaccattgtctttatcgtaaaagccgcctttaacccagaagccgcattgggtggtgtatttggttttaccgtattacaagctattcaagctggggttgctcgtgggattttctctaacgagtcgggcttaggctctgcacctattgccgcagcggctgcacatactaaagagcctgttcgtcaagggttgatctcaatgactggcacattccttgataccattattgtctgttcaatgacaggcttagtgattgtattaactggggtatggacaggtccaacacaaggggcagttttaactaacttagccttctcagaaggtttagcaagctctatcggagcaatgattgtcaccatcagccttgtattttttgcattcaccacaattttaggctggtgttactacggcgaacgttgtttagtctatctgacaggcggacgcaccaaaaggattaaactctaccgcttgatcttcattatgctgattgccgtggcaccatttatcaaactcaatacgatttggacaattgcagatattgtaaacggcttaatggcattccctaacttagtcgctttgatcggcttacgccacgttgtgattgaagaaaccagaagttattttgagagattgaagaaagggttggtggagtagttatgatagattttaaatatctataggaatttaaagtcttatgtgaaacgggctgtattaagggaatacagcccgtttattataatctaatcaattagtttacgttttgcttgtgcacgtttacctagaattacggtaataacgaatgcaattgacgctgaaattgccataccaacacagtacatcgcaaggctttcaggtttaattgatggaatacctggtaaacctgctgcacctaatgcgattgcttttacattgaatagtgcgataaatgcacttgatgtacccgctgcaatcattgctgcgataaatggataacggtaacgtaagttcacaccgaacattgctggctctgtgatacctaataatgctgagatacctgatggaacagccataccacgcactttcgcatctttcatcacgaatgcggcacctaaacacgctgcaccttgagcaatgttagacattgcagcgatagggaagataaatgtaccgccagtgttcgccacttctgctaataattgtgtttctaccgcaataaaggtttggtgcatacctgtgataacgattggtgcgtagaatgtaccgaagatcgcaccgcctacaaagcctaagctatcgtataaccaagttaaacctgcagagattaatgaacctgcttcacgacctaatggaccaatgatagtgaacgctaagaaacctgcaatgaataatgagaataatggcgtgattaagttatccaagaatgaaggaacaactttgcggaagcctttctctaaagttgctaatacccacgcagaaactaaagtagggataacagtaccttgataacctactttctcaatttctaaaccaagtacattccagtactggattttgccatttgcaagggttaatgcatagttccaaccgtctgctaatgcagggtgaactaataacataccaagtgcagcccctaagaatgggttaccgccgaatttacgggttgcagagaaacctaaaagaactggcaagaacacgaatggtgcatttgcgaaagtgttcattaagtccactaaatccgcaatacctgggtacatatcaacaacattcaaaccttctgcaaagaagccttttgcagtaagcattgagtgaatacccattaacaaaccgccagcgacgatagccggaatgataggtacgaaaatatccgctaaaccttttacaacgctttgtaagaaaccttgtttgtcagcaccagtactagcaacttcagatgttgtcatatcgccaatacctaagattttcgtcaattcagcgtgaactttatttactgtgccagaaccaaaaataatttggtattgacctgcaaccgagaactgacctttaacgccttcaatgttctcaatgccttctttatcgattaaagtttcatctttaaccaccatacgcaaacgggttgcacagtgtgctgcggcagagatgttatctttgcccccgagtttatcaatcacttgttgagcgatttgaggaaagttcatagttaccacctattgtgtatagaaatactaaaaattaaacagtggcattttaactaaaacggtttagctaagaaagcaaattttgctaaaacgttttagttttgtaatctagatcacatttttagcaagtttagctactatgagaataatgcgtctgatagcatatgaaggatttgttataattgaatattctcagtgttacaaattagagagaacaaatatattttttaggaaatatggaacttatttttaaaatgcttctctaatttatgtagaagttgattctatttttctatagaacaggagaaacaatgaaaaaatcattattaagttacagtttatcgttaatcttaggcttaggagcggtggcttccttgcctgtttttgcaaattctgcgacccaacctaccattatcacaaatactcaacagcagttaggctttgaactaatcaaaacaaccattaataaaagcccaacggataaagctatctatcaaggtattcgccttgcgaatggaatggaagtattgctgatttcagatgacaaagcaaataaatcgctaatgtctgtcggtttgcctgtcggttcaatggacgacccagttaagcaacaaggtttggctcactatttagaacatatgattttgatggggtcaaaagccttccctgaaactaacagtttagatggctttttaacgaaaaacgggggttacaataatgccttcactgcgtcagatcgtaccgtttattatcttgaagtgaataataacgcctttgatgaagcggtggctcgccttgctgatgcttttgcacaaccgctattgtccgaagcgaatgctaaaaaagaagtgaatgcggttaatgcagagatggtgcgagcaaaatccaacgatggctttttaatgcaagatgttaatcttgctaccgctaaccctaaccacccgattactaaatttgccgttgggaataatgtcactctatccgataaagccgagagtaagttacaagatgaattagtgaaattttatcaacaatactattctgcaaacttaatgaaagcggtgctttatgctaatcaaccgattgaaaaactagcaaaactcgcagaacagactttaggtaaggttgaaaataaaaagctcaccgcgccgacggtggatatgccatttttccgtgcagaagataaatcggtgatgatccattataaaccagtgaaacccagcaagatgttagcaatttcctttgatatgcctgaagataaagctcagtttaagcataaaacaggggattatctcgcttatgtgttcaataataatactgacggcacattgtccgattatttgattaaacaaggactgtctgacagcggtgttcaatcggtagcgaataatgatgttagtcgcaaccgtggcgattttaccttttatattgaattgactgacaaaggcttagcagaacaagataaaattatctcgttggtttttcagcaaattgaagcagttaaaaaagcaggtattcaacagagctattttgatgagctaaaagagagcttaagccaagagtttcaacatcttcagacggaaaaaagtggcaactatgttgccgatttggtgagccaaatgatgagttatccgctcgaaaatatcatcgaccagccttataccattgaacaaatggatacgcaggcgatcaatgcaaaacttgcagagatgaccttagacaacgtgcgtattttgctcgttgatgataaagcgaaaaccgataaaaaaaccaaatattttgaagcaccttatgcagtgcataaaatcagcgagcaacaaaaggcaaaatggctcaattttagccaaaatcctgagcttaaactgcctgcgttgaacccatactttgcaacggatttcagcttaaatgaaagcgataaatctcgtttaaaaccgcaactgattgaagcagaacaaggcacgcaaatctatgcaatgccaagccactattttggtaacgagccaaaagctaaaatttcattagggttaggcattacgccaaaagtagaagatctcagacaatcagtcagtgcaacgttgcttggctatatgagtgatttagtccagaacaaaattgatttccaagcctctattgcaggaatgagtgcgagtgtatcaatggcagaaaatggcgttgtattacaagcggatggttacacccaaaatttagcaaaattgctgaaagataaaatggtgttattccaacaatttacgttaagtgaagataccttagctcaagcgaaacagcgttatcttgaagccttagatcgtgcagaaaaagagaatgctttacgccaagcaaatgcggtaattactcgtttctccagttatccctattttgaaatggcaaaacaacgagcaatgatcgaacagatcagcttggcagatattcagcaaatgcgtgaaaaattgctgaacaaagcgacatcattacgcgttcttgcggtaggaaatctttcagataaccaagtgaaacagattgcaacagaagtcgaaacggtctttaacaatcaaaatagccagattgatttaggacgttatctcgacattaatcagagccaacgcaagctaaatcatattaaacagatttctcacgaagataacgccttaacaatcgcctattttccaaaaggttatgatgagttacagggattaagccgtgccagtttattaaaagatattctctcacgttggtattttgatgatctgcgtacagataaacagctaggttatgtggtttacgcctataacacccgtatcggcacaacatcaggcttgcaattttcggtacaaagcccgacggcttcaccaaaagagataatgcaacataatgaacgcttcttcaaagaaagtttggctaaactcaatgcaatgagtgccgaagagtttgaaaaatatcgagcaagcctacttgaagtgttacaacataagccagagtccttagaacaagaatttgctgaatttgtcaccgatttttcacgaggcaacgggcagtttgaccgtaaggcaaaattgattgaattgattaaacagctcactaaacaagatattcttgatttctatcagcaggccattatcgaccaaacaggttttgtttttgccagccaagccgttggtaaaaatccgaaaattagccaagtcgcagaactaaaaggctttgagaaggttgagagtgtggaagcattgcagaaggggtttgagattaagcggtattagtgttttgtaagcctttaatggcacatgtttgattaagtaaaacatgtgccattgtaagataggtatagttaccaaagtgttgggaagaaggaaattttctttacaacgagcccattttaatattattacggatactactctttaattaaaaggatttatataactgtcgagtatgttctaatagtttacggcgtgaaaagaaaaattgccagcggctaccgcccatttgttgccacaaaatccctgcacggatacctgccaatagcgacgctcttacccgattttgaatatcagggcgagagaggtaatcgtgcatacccaaaacgtgaatgcgagaacccagtgggctgataatatcgctataaatactcgcaatgttcgcaatcatctgatcgtgtaaaatatcgttatcatacagcgcaagctgacgttcaagttgttgcaaacgttgtgctaaatttgcttttgcttggggatttttagctaacttttggcttaacgctaatatgctgatccaatagcgaccaatttctgtgtcaagtttcccattcgccccaccaaattgagctaatgcggtttctaacccttgcttcaaatgagctaaatcgcccccgaaaacatcaagtgttgagccaggttgggtaataagtaaactagaaagagagtgtctaaatgcatcacgatccgcaaagcctttatgagcaaattgttgaacaaggcttgcagactggcatacgccagctaatgcgatggaaatatcttgatagtgagccattttcttgaaaaaaatttacaaaattagctgggaatatagcattttttcattaagttttgaacgcttttattttattgcattttccccttgtatttcctaaatctacccccataatgtacaaattctattttaggagagcaatccaatggcaagaaaaaagaaacctattgaattaccattacttccactgcgtgatgtggttgtgtttccttatatggtaatgccgttatttgttggacgtgaaaagtcagtccaagccttgcgtgcagcgatggataccaacaaacaactgtttttagtgacacaaaaagatccaaacaaagaagatcctacggcagaagatatttatgatgtcggggtgatggcgaatattatccaaatgttaaatcttccagatggcacggtgaaagtgctggtggaaggtcaagtgcgtggcaaaattgagcatattcgtgatgatgaaagtggtttttgggctggcgtttccccgatgccttctgattatcaagatgataacgaagagttaaaagcgattgccaaaactgcactcaacgaatttgaaaattacgttaaaagcaataaaaaagtccctgcagaaattttgccgaaattgcaaaaaattacctttgaagaccgcttggcagatacgatgtctgcaaatttgattgcttcggtaaaacaaaaacaggcgttgttggaagagcctaatcttattgctcgttttgaagctttgttgttagcgatggcaacggaaatggatacaatggaaaccgaaagccgtatccgtaaccgtgtaaaacagcagatggaaaaaaatcagcgtgattattatttgaatgagcaaattaaggcaattcgtaaagagctgggtggcgaagaagaagcggaacagagtgaattagataagctcaaagagaaaattgctgaagcaaaattaccaaaagaagtgcaagaaaaggtggatagcgagtttaataagctgaaagcaatgccacaaagttctgctgaagcgacagttgtgcgtagctatatcgactggattttacaaatgccgtggcataagcggtctgttgtgaagaaagatttgcaaaaagctcaagaagtgttggataaagatcactacggattagagcgtgttaaagaacgtattttggaataccttgcggtacaaagccgtttgaacaagctcaaaggcccgatcctttgcttagttgggccaccgggcgtgggtaaaacgtcactgggtcagtcgattgcgaatgcaacaggcagaaaatatgtgcgtatggcattaggtggcgtgcgtgatgaagcggaaattcgtggtcatcgccgtacttacatcggttcaatgccgggacagttgatgatgaaaatggcaaaagttggcgtgaagaacccgcttttcttactcgatgaaatcgacaaaatggcacaagatatgcgtggcgatcctgcgtctgcactgcttgaagtgcttgatcctgaacaaaataaagcctttaacgatcactatttagaagtcgattacgatctatctgatgtgatgttcgtggcgacatcaaattcaatgcacattccacctgcattgttagaccgtatggaagttattcgcctttcgggttatacggaagatgaaaaaatgcacattgctaaagagcatttgattgcgaaacagcaagagaataacggcttgaaagctggcgaacttgtgattgatgatagtgcgattttgggcattattcgttactacacccgtgaagctggggtgcgtagccttgaacgtgagattgcgaaaatctgtcgtaaagcggtaaaagcgttagtgatggataagaagctcaaatcgatcaccgttatccaagaaaacttaaaagattacttgggcgtacagcgttttgattacggcaaaatggatagccagaaccgtatcggcgaagtgacaggtttggcgtggacggaagttggcggtgatctattgacgattgaaaccgcttctgtggctggtaaagggaagttctcttacacaggttctcttggtgatgtgatgaaagagtccattcaagcggcaatgatggtcgtgcgtgcaagagcagaaaaactaggcattgcgagtgatttccacgaaaaacgtgatattcatgttcacgttcctgaaggcgcaacgccgaaagatggcccaagtgcaggtattgcaatgtgtactgcattaatctctagcttaacgggcaatccagtgcgtgcagatgttgcaatgacgggtgaaattaccttacgtggtaaagtcttgccaatcggtggcttaaaagagaaattgttggcggcacatcgtggtggtattaagactgtgattattccaaaagagaatgaaaaagacttggaagaaatccctgaaaatgcaaaacaagctctagccattcacgctgtcgaaaccattgatgaagtgttggcaattgcattacaaaatccacctgaagggattgagattgtgtcaaaatctattccatcaattaaagtgaagaaaacaaaggctcgtccggctatgcaataaatagttgatactagctaaggtgactatgcctcattatttagagtgtaatagacaaattttctgctaaaaatggtttaaagccttgtactatacggtattataggctttaagccgttttttagcagtcattttgtcaactatgccaaacaatttcaaaattagagaatcgctctacgcaaaatttgaatttctactatctaaataatcttatttactaaaaacgtcaaaacttcataatgtgccgtatggggaaacatatcgaatagttggacttttttgagttcataatggctgagtgaggcaaaatcttttgccattgtttctgcattacaactggaataaatcaagtagggtgagccgagttgattgataaattcggctaacggtttgcctattccccgccttggtggattgacgatcacaagatcgggctttgttccttgttcattcaaggcaaattgagccgagtccaacgaagcgaatttgacattttgtaagccaagttgttgggcggattttgtggcactggcgatggcagaggcagaaatctcaatgcctgtaagtgcgacattcggattattggcttgtaatgtgtgggcacaatgtagcccaaagcccccaacaccgcagaacagatcccatagttgcgtaatcggcaatgcttttatccacgcttgagcagtgtgataaagttggctggcgacagttggattggtttggaaaaatccttgcggacgaataaatagtggaatttgattaaagcgttcttctaacacttgctgttctgtcagaaaaatttcttgttcaccttccaaaatggcggaatgttgcggttgtatattcaaactcaccaccgatttttcaggcagttgagccagtaacattggcaattcacgctcaacaagcggtcgttttagctcacttcttaacacaaagcggatcatcaaagattgattatgctgactttgggtaatcaagatgtatttgagttctccccgtttttttgccacgttgtaaggtacaagcccagcccgtccgataaaggttttcagaatagggaaaagtgacgtaaaggcttgcggatagagcggacagtctgttaaatcctcttcatttaaaatccctaaaatcgggcgttcaacactgcctgtgactaccattttggctttgttacgaaaatgagccaacggcgatgtaaccgccggtaaaaattctgtgctttgcaaaagataaggcgaaactaaccgcttgagatcagcggttttctctgctagctgttcggtgtagcttttattaagccattggcacgaattgcaacggttctgttcaaaatggtggcagttgagtttaggcattttgggctttccattccaaccattgatcttgaagtgtagcaagttgttgatgagcctgttgccaacgtgggctagcggttaattccgaccagctaatttgcttccgtttcattaggcttaagtagcgttctttctgtgttggggtaggttgatatttcaaattatctaacacttgcaccacaccgtcaggctcattgcagagtagtaataaatcacaacctgcttgtaaggctttctcgcttcgttccacatagttccccataaaaccagcccctttcattcctaaatcatcagagaagatcacgccattaaattgtaactgtttgcgtaaaatcttttttagccagtaacttgaaccactggcaggttggctgtcacattgggtgtaaataacgtgagcaggcataatcgccgataattttcctttggcgatcagctgtttaaacggctgaatgtcgtgattgaagatcgtttcttttgggcgatcatcaaagggcgtttcaagatgagagtcggcaataacgtgaccgtgacctgggaaatgtttgcctgtggctgccataccgatttctcgcataccgtcaataaaggcttcagcgacaggtagcattgtggctatatcttccccaaacgagcgatcgccgattgccttgctacaatgcccgagatccaacacaggggcaaaacttaaatcaatatctaatgcaaacatttctgcggacattagccagccagcttcttgggctagttgcaagcggtctaattgtaaaaaagattgcattgcaggcaatttggtaaatccttcacggaaacgttgcactcgaccgccttcttgatcgacggtgattaataatggctttttcactcgttggcggacagatttaactagagcttgtaattgggctttatcgtgaaaattgcgtgtaaagagaataagtcctgaaaccagtgggtgttcgagtaactcttgttcttcttgagtaagttcgtagccagcaagatcgataagtagcatgataaacctttgtaaaaattattatttttcttttaagaaagtcagtacttttgccaaatcccttgtccgtttcgacggtggtaggcttttcaaaaaagttgagccgtattgtcgcattacaagacgagagtcacagataatcaccgcccccctgtccgttacatcgcggatcaaacgccccacaccttgttttaaggtaatcaccgcttcgggaatttgaatatcattaaacggatcgccaccttgcaacttacaatcttccattcgagctttcagcaatggttcatcgggtgcggtaaaaggcaatttgtcgataatcaccaacgacaacgcatcgccccgtacatcaatcccttcccagaaactttgcgttgctaccagtacactatttggctctgcaacaaacttctcaagcagacgacttttactggtttccccttgcaacagcacgctcaacgaactctgttctcgcaagaaatccgctaaaccacgcatcataaaataggacgtacaaagtaaaaaacaacgcccattattcgcttcaatcacaggtttgagcaactgccccaattctgtcagtgtatgggatttattcgtatcaggcagataacgtggcacacagagcaacgactgacgagcataatcaaacgggctttgcaacaccatctgttctgcattctcaatgcctagtcgctggcagaaatggtcgaactttccgccgacttcaagggttgctgaggtaaaaatccaaccaacttgatttgctctcatctgctcaccgaatttatcggcgaccgtcagtggcgtaatgtgcaagccgaaggaacgcccattgatttcataccaataacaatagccgacaacactagtatcgcccaatctttttaactgtgctttgacttcagccaaacgttcaaagattttatccaaggtttctgaacgaccgagcgattttttcaccacttcgcttaaaaaatcaatgttctcattcagcttagcaaagccttcgactactttcggatcttgcaaaatttcacgcaaattcccccgcttgttaccgtcccctagcaacaaacggaaatcctgcaccactttttgtagatgatcggacgctttacccaactgagcaagatctttcaactctgtacgataaacaatgttactgtctttgcaaatatcaaataattgacgagatgtcagcgattgcccaaagtactggctagcaatatcgggcaactgatgtgcttcatcaaaaataatcagctctgcatcagggattaactcaccaaagcctgtttctttcacagccatatcggcacaaaataggtgatggttcaccacaaccacatcagcttccaacgccttgcgtcgagcttgtaccacatagcactctttataattcgggcaatccgatcccaaacagctttctgctgtcgaaactaattgcggtaaaatcggactatcttcggcaatggtgatacattcgctcaaatcccctgtttttgttcccgtgtgccatttccgcaccttcgccaaatccgccaacaccgatttatcgccaaccacgcccattgcgatcacctgatctaaccgctctaaacagagataattagcacgcccttttaataacgccacttttcccttatatttcaaggctttttgaatggttggcaaatcacgattaaataactgatcctgcagatttttagaacccgtagaaatgatcgtttttttgcccgatagcaacgctggcacaagataagcaaaggttttccccgttcctgttcctgcttcaatcaccgcacttttggcaaatttcaccgctctcccgaccgcttgtgccatttctaactgagcatctcgcggacgaaaaccgtgaatgttttggcttaacgtgccttcggggctaaaagcgtcggtgattttttcggatagtttcatttgaataagtaacgtaaagaatcttacatccatgtaagagatttaacgatagctgaagaatggaaaatacatcaataatctgtactcagaatattaaattaacactattttgtaccaaaaatcttatcgccagcgtcgcctaagcctgggataatatagccgttttcatttaaatggctatcaattgcagcggtatagagttcaatatcagggtgagcttcttcaagtgctttaataccttcaggtgcggcaacaagcactaacactttgatttgtttacagcctgcagcctttaaaagatcaagggtagcaatcatcgatccacctgttgctaacatcggatcaaccacaatcgctaaacgttcacctacatcgttagctaattttttgaagtaaggcacaggctctaaggtttcttcgttacggtagatacccacaacgctaattctcgcacttggaatatgctcaagtacgccgtccatcatacctaaacctgcacggagaataggcacaacggtcacttttttacctttaatacgttcaatttcaactggaccattccaaccttcaatggtaactacttccgtttccaaatctgaggtcgcttcgtaagttaaaaggctaccaacttccgttgctaaggcacggaaatctttagtgcttacatcagcggcacgcattaaaccaattttatgtttaataagcgggtgttttacttcaacaattttcatttttggtctccggttatgtttaaaaaaatcggactattctagcagaatttaacaaagaaagtttaatctagatcagataaaagttcccaaaatgcacgaatgatcggttcttgcaaacgacgttgctgaacgcaaacgcctaactcaaatgcatcaatcggagtttctaattgaatatgggaaatctggtttgccacagggctttgttgaacaacaacatcggggatcatcgcaacaccacagcccaaggcaaccatcggcacaatcgcttcgtgtccttccactgtcgcataaattttaggctctttaattttttgcaatttaaaccaatgatctatccgcttgcgagcaggcccatcaacaggcaagataaaaggcatattctgccaatcaatcggtgttttctgtaacaattgcgttgcagtacaagcaatgcgaggagcaactaacgataattgaatatcatcaatatagtgaaaaataatgttattgggtaagttttcaggcttcccagcaagagaaatatctgactgcaacgattgaacgctatacagcgctttagcaggatcgcctgtactcaatttgatctcaatcttgggatagcgttttctaaatttcgctaaaatgcgtggtaagtggctgtaagaagcggttacagagcagaaaagtttaagctcgccttccaattcagtttgatctggagaaaaatgtcgttgaatttgttgccattccgcccaagtctgctccgcaaaatgtgaaaaacgttcccccgcttctgtcaaaatcacttgccgattatcccttaaaaacaacggctgcccaatctcttgttccatacgttgaatatggcgagaaagggtagaagcactcatatagtttttttttgcagtgcgaataaaactacgggtttgagtgatgtctaaaaaaagtttaagggattggaggtccatttatttatatttcaacatacaatgttatacaaatatacataaaaataatcattttctatgtcaaatacatatgtaatatttttcactatttaaattcaacagttcttctacgaattttttcaacaaatcttctaaattctttagctatactatttagtatattttttttctttctatactcaccaattttcttaaggcgaattgctctatcagtttcaagataacttggtaaggctgatacttcattattataaaatctttcttgaatgcacaaggcaggatttaattgaaaaacagttagttctttatttaagataaaatgattaaataagagttcatcaatagcgtctaatgaatttggtggtaattgcttgattaactcaactgctttaactgcagctctcttagagattatatatccagcagctcctacatacgatctgtttaacttgaaaatctctctatctaatacagaatagcggggcgttcctttaattacttttttaggaaatgattctaattttataataaattcttttcttacatctaaatgctcaaaccagtcataattatttaaatatttattactattttcacctaagataatatcatcttcaaatatagtaaaataatcataattttcattaataccttttaataaaagcatataatggctcataaaacaggctttttctacttcagtaagcgaactttcttttaaattaggaagatagttattgatatgctcattaagtatctcagatgggtataatgcatcaaagaatgcaaaatctatattatgtattttaaattcagaaataatatgctgtcttcttttttcagaatcttttaaactaatgacataattaaccattataatttccttcaatatgaattaactctatttgttattcaagtaattattaaaacttttccataatcatagaaataaggaagaactttaaaatatagcatacttgtaaataacatatttttatgctatcttatcataaagtttattttaacggaagagttttatggtaactaattatataattagtcttatatcagctgatataagacgctcacatattaataaagagttttcgtctaagaatattaaatttgaattttttgatgcatttcaaccactaggaaaagagaatataatagaaaatatattgccacaattaaataagaacactgttctcacagttggagagaaaggttgtcttataagccatttattactatggcaaaagtgtattgatgaagatatgccttacattagtatttttgaagatgatgttatcttaagtgaagatgcggaatattttctaaatgactattcttggatttcaggttctatgattaaacaagataattttatagtacgttttgaaacatttttgatgcctgtaatcagtgaaaaagctcaaaatattgctcctattaatggtagaaatatatgtattcttaaatctaaacattatggtacggcaggatatattatttctaaaaatgcaattaattatttattaagattaattaaatccttggaagcagaagatattaagcctatagatcaaataatttttaatcaattgttatcagatcagaacttatttatatatcaattatctcctgctatttgtattcaagaactacaattgaataaagaagaaagctcattatatagtcaaattgaagaagatagagcaaaacgttttataactaagcctaaaggaaaaatgagtatattaggtaagattctaaaagaattagatagatataaaaatagagataaacgcaaaaaacagagaatagaagagatagagctagaaaatcagaaaagtattattccttttgaataacattaaacctcaagtcttttactataaggcttgaggtattctttttttgtgtgtttttgattagtatatcccaaattttattcgatctttaaaatcattttttaatttcttgaaaatttggcgataatcattctgagctaccttatttaaccaatgttgtggtttattattaattgaattaaatagcttaataaataattgagacttagtatgattgcatttactatgccaaggcttatcttcaccacaataatggaaaatagagattgggaaatttggtctttcttgatcactcaattgctgtttttttaatattcgatatctaaggtaaggttggaaattatatttggtgttaattatcttaaccttatttttaaaaataatattcaaaatatcctgatcttgaaattcaatatatggatattcttttatacatactatggctttagtatataaatcaaaattttttaacttattaagatctattaataatactccagcgttaaagtaactattagattcatcaaagcctatttttgctttataattatccaaaccatattcaacaaatgaatcaaaacaagccgcaatatgatatttatctagatttatattccataaatcaataatgctacctgctattaataagtctatatctagataaataactttatctacattctttacataatcagctatttttaatcttgcatatgtcgttttagagatatgtgaaattgtttggggaaattcactgaaatcatcttcatttataggaataaactctatagagcctctatgattatctactatgtttataatacattctttactttcactagatatacctaaatccaatacataaaaattcatcataattttatgatggtttagaatgcttaatatatttactgcaagatagggggaatatttttcatcgcaacaaaaaacaatattcatctataactcctattatatattacttatatatttatatggtctaagcattttttttattatcttaactttttgtttaaaagtaaaacatttggcattactagtaaaaatggttctgcatatggtgtatgaatctacttttgcagacataaagcaatcgaataatatttttttaagattttctatatctttataagttagtctattccaaacatctttttccagcaagagcttattaagtacactaaatttgatattatcaaaatctattatattaacgaagcctagattttccatatagtaggtaataatctctcgtctaattttttttgcagtatttatttgtgaggcattatgatttgatgatgtttgttctgaatgtaatctataataaactagagcttcaggataatttgccatctttcctaacttacttacttcaaaccagaatttataatcttcagcatgtatataattaagatcatatattaaaccatattttttatgtattaaacttttcataatcattgtattattatgaataggattatagaataacatatcattcttaatatgagcatctgttagtgcatttttccaaatatctcctgttttatagtatttacccagctttccattgacagatatgatttctagatagcaacccattgcaataattgtaggatcttccaacattttctctaaaatgtttttaatccaatcaggtttggctacatcatcagaatctattttagcaatatattctccttttatatgttgtatccctttatttaatgaagatatatatccaatgttcatttcattatttatgatactaattctattatcttgattagctaacttttctatgatatgttttgtattatctgtagaaccatcatttacaataactatttctaaattagtatatgtttgatttattacagagtttatacactgttcaatatatttttccgtattataagcacaaattaaaactgagactaaagggagatgcataagatcctctaaatataaatttcatttttgagaagctacactatctatcgtaggcacttctctcatttgagattggattatattattaaatttcaagggaatggtaaatcccgttttcaatgatttattaattttttcaattataaaaatctctcatatttaaattcataaaattagtaaagtttttacaaaaaatcatttaccatgatcccattattttacttgtaatcttatccttatattttatagatgaaaaaatcttatattttgattattacagctcattctcttcttacaataaccctaaacacattctcaatccgctcatcaataaactcaacattaggatactcttttaatactcttaatataccacttcctagccctctataaggaagtgctctaggagcgaaagaggcgagaatcgggtttcgtatattggagttacctagttttatattttcaattgtaagattattcggcaaatgcccagggctaataatctcaatacgatcattaaatattaaaattcggattggagcagaaataaaataatctcgatgaatgatcgcattagcaatcagttcttcaaacacaattcttggtatttcaggttctccaagagagttaaaactttgtccattttgtttgtgctgaatattggttaagataaaacttatggcttggcggaactgttccgtgatattacctcgaatgtctttactatcaatatagtgttgttccgtaatatcatttcctagaaatgaaacagcttttatgataaatgttggtaaatatctacttggatctttagtaaataataacgctccgcaaatattaaattcaccctttttcattacattcatattttcaagtaattgagctttagaaaaatgttggctagttacgggttcaccataaaacttctcaaaaaagtgatcaaaataaacttcatcaagatcttgaatagatgacccagtaacaggtaattcatctgcgtgtacaagggaagcttcacgaaacattcttaataattcttctcgagctgttattttacgtttatcggctccactttttgtccaaaaatagccctgagaatccatatacggcttgctaattccctcggaaatatggacgacgataacaattccatctggaaaggtaatattttcagtaagtggagaaattgatggatggacattttgagatgcgacattagcaataagttgattaagcctaaatacatcatcattagttagaccacttaatgtaccattatcatttacgccaataagtaagattcctcctagcgagtttgcaaaagcaaccatctcagcggctaaagcatcagggtgagtaacattagctttaaactgtaatttgctaccttcccctttttgtatcaaagcaagtaattcagtatctaacataatcttagcgtaattttcaaacataaaaaaacctccactattgtggaggttttcccgaaaaatttcaaattattttgtgcttggaatgctgaagcgtttgttgaagcgttcaacacgaccaccagtatcaacaacacgttgtttaccagtgtagaacgggtggcagttgccacatacgtctaagtttaaatctttacccgctgttgagcgagttttgatcacgttaccgcaagaacaagttgcagtaatttctacataatttgggtgaataccttgtttcattatagaaaacctctaacgaagccatatcgccactagagcatactactcagctgtctagtaccatatgtatgaataaaaaactaggcagaagcctagcaccaaaaagagtgagcattctactcgaaatttttgaaaatgacaatattgaatcaagattgtagacgatacttgtacttttcgactatttttaggtaagtgtttttgcttatcaagaaaattttcattaaaatctcgccgcttatttactttatttgaaaagattatgattgattttcgtcctttttatcaacaaattgccccctcgccgttatctgcttggttggaaacacttcctttacagctcaaacaatgggaaaaacagacgcacggcgattatgccaaatgggcaaaaatgctagaccatttgcctagtttgccttgtgaaattaatttggcagataaggttgaagcccgtttggttgagccgttgtctgcaggtgaaacgcaacgcttggtacatcacctaaaacagcttatgccgtggcgaaaaggtccttaccatctgtatggtgtacatattgattgtgaatggcgttctgattttaaatgggatagggttttgccccatttatcaccgttaaaagaccgcttgattttagatgtgggctgcggcagtggctaccatatgtggcgaatggtgggcgaaggggcaaaaatggtggtggggatcgacccgacggaactctttttgtgccaatttgaagcggtgcgaaaattgttaaataacgaccgcagagccaacttaattccgttaggcattgagcaaatgcaacccttgcaagcctttgatacggtattttcgatgggggtgttgtatcaccgtaaatcgccgctagaccatcttgcccaactgaaaaatcagttagtcaaagggggagagctggtgttagaaactttggttatcgacggtgatattaatgatgtgctggtgccggcagaccgttatgccaaaatgaaaaatgtgtattttatcccgtctgtaccagcgttgattaattggcttgaaaaagttggctttaaaaatgttcgttgtgtcgatgaagcagtcaccacatcagaagaacagcgtaaaacagattggttagaaaatgaaaccttggttgatttcctcgaccctcaagaccattccaaaacgatagaagggtatcctgcaccgaaaagggcagtgattattgcgacgaattaaaatatcataatctctctagtatccaaagttttccccgttcttcagaacggggatttctactagcatccagtaaatctaatgcgcatcttttataacccagctttcaaactcgcttcaataaacttgtctaaatcgccatctaacaccgcttgggtattgcgattttcaacacccgtacgcaaatctttgatacgcgaatcatctagcacataagaacggatttgactgccccaaccaatatcagacttactctcttccatcgcttgtttttctgcatttttcttcatcatttccatttcgtagagcttcgctttgagctgtttcatcgcctgatctttgttttgatgttgcgaacgtccgttttgacactgcaccacaatacctgatggcatatgggtaatacgcactgcagactccgttttattaacgtgctgaccgcctgcaccagaagcacgatacacgtcaatacgtagatcggcagggttgatttcaatgtcaaaatcatcatcaacttcaggatagacaaaggctgctgcaaaagaggtgtgacggcggttattggagtcaaacggacttttacgcactaaacggtggatccctgtttccgtacgaagccaaccgaaagcatattcgcctgacacacgaattgtcgccgattttaatcctgccacatcgccatcggatacttcgatcaactcggttttaaagcctttgctttctgcccaacgtaaatacatacgcagtaacatttccgtccagtcttgcgcttccgtgccgcctgaaccagcttgtaaatccacatagcaatctgccacatcgtgctgaccgctaaacatacggcggaactctaacaaggctaatttttcttctaactggttagcttcttgttgagcttcgttaaaagtttcttcatcttccgcttcaacggcaagctcaatcaagccttcgacatcttcaatgccttgctcaagtgttttaatcgtattcacaatagtttcaagagcaacacgttctttgcctaacgcctgagctttttcagcattattccagacatcaggctgctctaattcggcattgacttcttctaagcgttcgactttcagattgaagtcaaagatacccccgaagtgtacgggttcgttcggctaaatcatctaattgggttctaatcggattgagttcaaacatagttattccttgtagttttaaaagcggagcattatagcgaaatctaggaggatgacaaactaggggatttatccttgtataagaatcatgtatttacctttaccctttaaaccctagatataaaacacaaatgttgtaagctagcggccaatgtctattagccgatcaataacctttggctttcaacacattgtgcggtattattgagagataaattaaggagttttatatgcaaacacttactcaacaactattaaatgatgtccttaatattgccgttcaagcaggagaacatctcaaacgcttttatcagcgttctgtggaaattcagattaaagcagataaaacccctgtgactgaagctgatctttttattagccagtttgtgattgaacaattacagaaattgaccccaaatgtgccgatcttgtcagaagagaactgtaaaattccactttcggagcgttcgcaatggcaagaatattggatcgtcgatccacttgatggaacacagcaatttattgatagaacagatcaattttcagttgtgattgggttggttcagcaaaatcgccctgttctgggtgtcattcattcgccgatcttagacaaaacctactatgcaatgcgtgcaagcggtgcttttgttagagaaaatggcgagatccatcgtcttaattcgaatagccaaaatgacgataaatcacaccgcttgcaagtgactattggtacgtcaagtagcgacaaaattcgccaagctgtgcttcccccttatcaagtagattttcttcaattcggttcaagtagcttaaaagctgggttggttgctgaaggtaaggcggattgctatgtgcgtttaggggatactggagaatgggatacggctgttgctgaagtgttactcgcagaaacaggcggtcaggtcttcgatcttcacttccaaccgttaagctataatcaacgtgaaacctttgtaaacccttattttataatggtggcaaataaacaacgtgattggcaacagattttttcttttaattgattttatttattgttatattttgttatgaaatctaacaatttttttacattttctaggattgcaaatgaaagcagacaataattgtattgtgatttttggtgcgtctggggatctcacctaccgcaagttaattccagccctttataatctttataaaatcggcagactttctgaacatttttctgtattaggggtcgctcgttcccctttgaccgatgaaacttttcgtcaaaaaatgcacgacaccttagtcaaacttgaaaatgcaagcggtgatgtgttagaaaaattttgcgaacacctttattatcaatcggtaaatacgtctgatgcagtggattatgcaaaattattgccacgtttagatgaactgcacgacaaatatggcacaggcggtaatacgctatattatctttctacgccacccagtttatacggcgttatccctgaatgcctttcagcacacggtttaacaacagaagaatttggctggaaacggatcattgttgagaagcctttcggctacgatattgaaacggcaaaagcccttgatattcaaattcacaagtattttgaagagcatcagatctaccgtatcgaccattatttaggcaaagaaaccgttcaaaatttgctcgttttgcgtttttctaatggtctatttgaaccgctctggaaccgtaattttatcgattatgttgaaatcacaggggcagaatctattggtgtagaagatcgtggcggttattatgatggctcaggtgcaatgcgtgatatgttccaaaaccatttattgcaagtgttagcaatggtcgcaatggagccacctgcgattattaatgccgattcaatgcgtgatgaagtagcgaaagtactacattgtctgcatccactttcaaatgatgatattaaaaataaccttgttttaggacaatataccgcaagcaccattaacggcgaagaagttaaaggctatctacaagaaaaaggtgtgcctgaagactctaacactgaaacctatatggcagtacgttgccaaattgacaactggcgttgggctggtgtgccattctatgtacgaacaggaaaacgtctaccagctcgtgttacagaagtggttattcactttaaaaccaccccacacccagtctttagtcaaaatgcccctgataataaattgattattcgtatccaacccgacgaaggcatttcaatgcgtttcggcttgaaaaaacctggtgctggctttgaagcgaaagaagtatcaatggatttccgctatgccgatcttgcttcaccaagcctattaacggcttatgaacgtctattattagatgcaatgaaaggcgatgcaaccctattcgctcgtaccgatgcagtacacgcctgctggaaatttgttcaaccgattttggactataaagcggaacgtgggcgtatttatgaatacgaagcaggtacttgggggccttctgaagccgataaattgatcgccaaacacggcgaagtgtggcgtaaaccaagcggtttgatgaagaaaaaagtgtaatcgtagggacacactgcgtgtgtccatatacattattgataacggatacctgtgtcccacaaggattttatgaactacatcacattcccgacagcacaaagtgcggtggaaaaaatcgcacaagaatttgtgttatatagccaattaaaccgccccgtacatatttccctatcaggcggaagcactccaaaactgctgtttaaaacccttgcccaagagccgtataaaagccaaattcaatggcaaaatctccatttttggtggggcgatgaccgtatggttccgcctcaagatcctgaaagcaattatggtgaagtgcaaaaattactgttcgatcatatccagatccccgcagaaaatattcaccgtattcgtggtgaagagcctgtggagcaagaactggtaagattttcacaagaactgaccgcttgtgtacctaatggcgagtttgattggattattttaggtatgggagcagacggacataccgcctccctattcccacatcaaacaaatttcaatgatccaaatttagcggttattgccaaacaccctgaaacagggcaaattcgtatttccaaaactgccaaattgattgaacaggcaaaacgagtgacttatttggttacaggggcaagcaaagcagaaattctcaaagaaatccaaacaacaccagcggaaaacctgccttacccagcagcaaaaattaaagccaaaaatggcgtaacggagtggtatttggatagcgatgtggcgaagttgttgtaaaaatatatcttaatttttaagcgattaccggagctaaatatggatttaatcaacagcagttatcttttagaaattaaacaaattctcgccaatgcacgccaaaaggcttataccgctgtcaattcagcaatggttgaagcctattggaaaattggcgaacgtattgtgttggaagaacaaaatggagctgatcgggcggcttatgggaaagagattataaaaaatctttctgttgaattaacgaatgagtttggcaaaggttttagtaaacgtagcctgtgggaaatgcgacaattctatgttttatttcctgattttccaaaagtgcgaacggtgttcgcacaattatcgtggtctcattttcagcgttcattaaaggtatcaaacgacaaagctcgtctttattatctaaaagaggccgctgaaaataattggtcggtaagaactcttgatcgtaacatttctacgctttattacgaccgcttgttggcaagccaagaccagagtatcgtcaaagcggagatgctggaaaaatccgtgccattacaagccagcgatttgattaaatcgcccaccgtattggaatttttgaatttaccgactaacttggcatacaccgaagcagagctagaaaaagcgttgattgataatctgcaacaatttatgttggaactgggcaaaggctttgcttttgtggctcgccaacagtgtattcgcaccgaaacgtccgatttctttattgatttagtcttttacaattacattttaaaatgctttgtaatcgttgagttgaaaacagaaaagctcactcatcaagatattgggcagctggatatgtatgtgcgaatgtacgatgatttgcaaaaacgccctgatgataatcccactatcggcttgttactttgcaccgaaaccgatagcgtggtggcgaaatattcggtattgaacgacagctcgcagctttttgccagcaaatatatggcgtatttgccaagcgaagaagagttggtgcgagaaattgaaaatcagaagatgatttttgagcaaaatcatagtgagcaataatggcagaaatattggcaaggctagatagatttttcggcgcctctaagatcaaaaattgtgatcttaaaatttaaatttgcgatctgtgtcgaaaaaacataaaaaagtattagaacttggttggaaaatggctcatcctaatttctatttgaaatcacgagttgtgacctcaaaatgctgaaggaaaaaagatgaaccaattagtacaaattaatcctaaattggaaacacaaatttttacggtaagaaatgtccaagtaatgattgatagccatttggcaagcctttatcaagtagaaacgagaacatttaaccaagcagttaaacgaaatttggagcgctttccagaggaatttcgttttcaattgacggaaagtgagtggcaatctctaagatcacaatttgtgatcttagagaaagaagaaaataaaaatgcaaagggtaaacatagaaaatatttaccctatgtatttaccgaacaaggtattgcaatgctctcaacggtattgcgtagtgaagttgcaattcaagtcagcattacaattatgcaggcttttgtgcaaatgcggcatacattgctaaataacctgggtgttattcagcgactagaaaatgtagaacgcaagcagattgaaatgtctgggcaattggagcaggtattcttagctctagaaggaaataaacctcgctctcaaggtatcttttttgatggcgaaacctttgatgcctatacttttgtagcagatttagtaagaaaagcagaatcttctattattttgattgataattatcttgatgattctgttttaacattatttagtaaacgtaaattaggtgttaatgtcacactttatacaaaaacaatcagcagacagttatcacttgatttagaacgctataatagtcaatatgaaccaataacgataaaaccgtttagtcaatcacacgatagatttttaattttagatcgctccgaactctaccatatcggtgcctcattaaaggatttaggcaaaaaatggtttgccttttctaaaatggacttatcaaccagtaaaattttagaacagttagaagaacaataagcaagcggtcagaactgcaaaaaattttgcaaaacgcaccacttgtaagatagagagaaaacaatgtcaatactggcgtatattttaaccacccttgtcgcccttgagcatttctacattatgtatttagaaatgtttgccttaaacagcccgaaggcgagaaaaatttttaatttagacgaacaaacggcaaccgatccaaaaattctgttgttgtttgctaatcaagggttgtataacggatttttagccgcagggattattttttctctttgtattcaacaaagtgcggtcacttttttcttcttaagttgtgtgattgtcgctgcggtttatggggcgataagtgcaaagaataaagggattttgattaaacaagggttgccagcggtattggcgttggtggcaaatattatatttactaaactttattaggagtacactatggaaatttttgttggtattatcattcttattattgtatttgttgttatttcattaaaatcagaatcaaagcagcttaaaatagctcaagaaaattatgaagaatcattaaggatgctaaaggatgatccaactaatgctgaattaaagcaacaaactttagcgttagggcgggtttactccaatttaactagaaactctgaaggagtaactactgtagatgaagtttctcttatgaatgatattaatgcagcttgtgcagcagctacttccattaatatcacaacacaacaggaagctcttgaagataggctaaataaattatctactttattagaaaaagggctaattactcaatcagaatatgattctcgtagaaaagaaattttagacagtatttaaatgtctgaaaagcatatatcaaagcgacaatgatagataaattaagaatagaaaataggagaatttatttcttatagtgttttttattctgcgtaacttatataaggagttatttatgaaaaaatatctagctttatgtattgccctattaacaggatgctcaactaccccaattacagaaagtacaggtgtttttgtttccaaagatagaatatatacaaattctttattaaccaaaacagcaaacagtgggactattaccgtttttagagattctggcttctttggttctgcatgtgatcatcacgtatttatggataaccaaagaattgcaacgttaaaaagtggtgaatttattaaattttatacattttcaggcgaacatataataaaaatttctgtaggaggaatgtgtccagatattgaaatgacagatacagttcaactaaaagaaaatcaggaagtaaaatatagaatattattaccatcggatggttctcttagattatcaagaattcagtaaactataatgggaaaacagttactagttagcttacgccagacggtagaaatacccatgactctaattaaatgaatataagtaaacaagtggttaaatttgcaaaaaattttacaaatttcaccgcttacagaatcaaaaccaacaggagcaaaaaatgtcagtaaaaggcgatatcggcgttatcggtttagcggtaatgggtcagaaccttattttaaatatgaacgacaatggctttaaagtcgtggcgtataaccgcactacttcaaaagtagatgagtttttggaaggtgcggcgaaaggcacgaatattatcggcgcatattccttagaagatttagcggctaaattggaaaaaccacgcaaagtgatgttaatggtgcgtgcgggtgaggtggtcgatcaatttatcgaggcattattaccgcatttagaaaaaggcgacatcatcattgatggcggtaactcaaactacccagacacaaaccgccgtgtgaaagcgttagcggaaaaaggtattcgctttatcggttcgggcgtgtcgggcggtgaagaaggcgcacgtcacggaccttcgattatgccgggcggtaatagcgaggcgtggcaatatgtgaaaccaattttccaagcgatttcagcgaaaaccgacaaaggtgagccttgctgtgattgggtgggtaaagaaggtgccggtcatttcgtgaaaatggtacacaacggtatcgaatacggcgatatgcagttaatctgcgaagcctaccagttcttaaaagatggtttaggtttaagctatgatgaaatgcaagcgatctttgccgaatggaaaaaaacggaacttgatagctatttaatcgacatcacgaccgatattttaggctacaaagacacagacggcacgccacttgtggaaaaaattcttgataccgcaggtcaaaaaggtacaggtaaatggacggggatcaacgcattagatttcggtattccattaactttaatcaccgagtcagtgtttgctcgttgcgtatcttcattcaaagatcaacgtgttgctgcatctaaactgttcaacaaaaccatcggcaaagttgaaggcgataaacaagtttggatcgaagcggtgcgtaaagcgttattagcgtcaaaaatcatctcttacgcacaaggttttatgctcattcgtgaagcctctgaaaacttcggttgggacatcaactacggtgcaacagcgttattatggcgtgaaggttgtatcattcgcagccgtttcttaggcaacattcgtgatgcgtatgaggcaaacccagacttagtattcttaggctcagatgcgtacttcaaaggcattttagaaaacgccttaagcgactggcgtaaagtggtagcgaagtctatcgaagtgggtatcccgatgccttgtatggcaagcgcgattacctttttagacggttatacttctgagcgagtccctgcaaacttacttcaagcacaacgtgactacttcggcgcacacacttatgagcgtaccgacaaaccacgcggcgagttcttccacaccaactggacgggacgtggtggaaatacggcatcgacgacttatgatgtataaataaaataggtgtaatagacaaatttgttgctaaaaagtggcttaaagccttatgatacaaggctttaagccctctttttgaaatatgaacaaaaaactgcccattttgccaaagtttgaaaataaagaaacatggtatacaaaataatactcagcgttatttttgtaatgaatgtcataaatgtcataaaacgtttatcttaaaaaactaaattagatccaattaagatttggagtgattacacatccggaaaacaaacctataaacaacttgccgaaaatatcattgttcaattagaacaattcaaagatatctcgaaaaagcccctaaaacagtattaaatccaccccaatcacgtgatttaaatattattgcggataccaccttctttggtcgtgaatttggtattttagtcctgatggattcgctttctaaaaaggtggtttaccatcgtgtcatcaaaacggaaaaagatgtttattacagaatagcgttcaattcacttcgtatgaaaggctataacattcaatcaattacctgcgacggcaggcgaggtttattgaaagatttattggatacaccgacgcaaatgtgccattttcatatggtagctattgtgatgagagtattacgaaaaaagcatcaatctatagctggaaaagaattaaaaacaatagcattaacgcttaaacagagttctaaaaaagacgtctatttacgattacatcattggtatttaaaacataaagcgttttttagaagaacggccaggtaaaccgaatgaaaagggctattatccttataaacatcggaatgtaagaagtgcttatcatagttttaaacgttatatggattatctatttacctatgaaaagcatggcgatttaaatatcgaaaaaacgacaaatagacttgaaaaaggctttaagccactttttagcaacaaatttgtctattacacctatatctgttacacgtatagatagtctaaataaaaagccaaccatagatatatggttggctttttatatgcttcttaaattagttggcggaatggacgggactcgaacccgcgaccccctgcgtgacaggcaggtattctaaccagctgaactaccactccgcagcaaacgaggcgtatattaatgatttcgttctctaccgtcaaacacttttttgaaaaaatttattgattgtctttttactatacaaaacgctctctttttaattcaatgtcgtgttttctgtcgccaattctctcgtccaaaggcaatttccttttgattttttatttatcaactcaagatatttaagatgttctgctaattcttcttcgtcaggggctaagacaatcaagttagaggtgtcgatatttaacggctggtaaacttgctctactgaagatgtttttgcttgctcgtgttcatcttcaccaataagggcaatttgaccgcctgtcatcatcaggaacacatcagctaagatctccgcatccagtaatgcaccgtgcaggacacgtttactgttatcaatccccaagcggtcacataacgcatctaaattgttacgtttccctggatacatcttacgagcaagttgcaagctgtccgtgacggtacacatctgtgccactttttcagggggatttggtaagaaggaaaactcgtggtcaataaatcctacgtcgaaaggggcattatggataatcagctctgcccctttgataaattcaataaactcatcggcaatttctgcaaatgcaggcttatccgccaacatttcgttggtaataccgtgaacttgcattgcctctgcctcgacttctcttggcggtttgatataaacgtgaaaagtccgcccagttaaacggcggttaattacttcgacagcaccaatttcaatgatgttatgcccaatgtgtggagcaccattgaaattcattcccgtagtttcagtatcgagtacaacttggcgtaatatttgttgtttgctcattgtattttcctaagttacaagcggtaggatttgcaaaatgttttacatatcttaccgcttgtgcttcaaattaactatccgtttttaattcatcaatcgctttttggtcgaagaaatattgcgcaccacaacattcacactgcatatcaattaccccctgtttttcggataacatctctgcaatgtcttcttcaggcagtaacaaaattgccgctcctgaacgctctcttgagcaaccacatttaaattctgtggactgcggttgataaacttccactgtttcttcgtggaataaacgatagagtagttcttctgccgttaaaccaaatagctcttcatctttgatcgtcgaagttaatgtcgccaaatgctcaaagtcgtctggtgaaccagtgccatctggcacgatctgtagtaatgttccaccagcaacggctttgccttgatattcaccaacacggatcacaagctgtgtggcgagctgttctgaacgagcaaaatagtcttctaaacactcactaacagtaggtttatctaagactataaccccttgataacgttcacctttttctggaataatcgaaataacgagaacaccatttccaaccatttcagcaagtgttgcgttatccgcaatatcaccttcaacacgagctaaagcgcgaaattgttgttgatgattgccgtttaccactgctaattttaacgctccgtcaccttgaatttgcacggtaattgtcccttcaaatttgagtgttgccgttaataaactggttgctaccaacatttcacctagtagattttgcactgctgttggatagtggtgggtatttaaagtttccgtaaaggtgtcatttaagcgaacccattcgccacgcaccgcacggttttgaaataaaaagcgataaagtttatcgttatcttgtgtataagttgtcattaacaatccttcataaaatacaagcggtgagaaaaatcaccgccgttacaaaacatatatggggacgatttaagtaattacaaatcgttctcttgatatttaaatttaatcaaatcccgccgctcttttttatttgggcgacgatctgggtgtggcattgataacgcatttgctttacgggcaaaggcgattttttctcgttcttgaatacttttttccgtttcttgataaagcagttgtgcttcaggcgcaccacgtcgttgatcgctcaacgtagtgacaacaacttctttttcatcgttgccttggcgtaatttaattattgccccgacttcgacaattttactggttttagcccgttgcccattgtaatgaactttaccaccttcaatcattgcctttgcaattgaacgagttttgtaaaagcgtgctgcccatagccacttatccaagcgaacttcattgatattatcagccattttttcccctttttttcaactattttaccctttttcacacaaacaagcggtaataaggcagaaaaaatttgcaaaattttccttttcgctgtattcttcgccaccacaattcatacaaacaaatctgaattaacctgttttaatccaatctttaaataacacaattattatttctatgcatcttacagagttaaaaaatacacccgtatcggaacttgtccgtatcggtgaagaacaaatggggctagaaaacttagctcgcttacgcaaacaagatattatctttgccattttgaaacaacacgcaaaaagtggtgaagacattttcggtcaaggcgtgttagaaatcttacctgatggttttggtttcctccgttctgccgatagttcttaccttgcaggccctgatgatatctacgtttccccaagtcaaatccgccgtttcaatcttcaaactggtgacaaaatcgaaggtaaaatccgcccaccgaaagaaggcgaacgttactttgcattgctaaaagtcgatttagtcaatgatgacaaacctgaagtttctcgtagcaaaattctctttgaaaacttaacgccacttcacgctaactcacgtttgcgtatggagcgtggtaatggttcaaaagaagatttaactgcgcgtatcttagatttggcttcaccaatcggtaaaggtcagcgtggtctgatcgttgcaccaccaaaagcaggtaaaaccgttttacttcaaaacattgctcaaagcattacgcacaactatcctgagtgtgaattaatcgttttgttaattgatgaacgtccagaagaagtaactgaaatgcaacgttcggtcaaaggcgaagtgatcgcttcaacctttgatgaacctgcaactcgccacgttcaagttgctgaaatggtaattgaaaaagcaaaacgtttagtcgaacataaaaaagatgtcgttattttattagactctatcacacgtttagcccgtgcttacaacacagtaaccccagcgtctggtaaaattctttctggtggtgtcgatgctaacgccttacaccgcccaaaacgtttctttggtgctgctcgtaacgtagaagaaggcggtagcttaaccattattgcaacggcacttgtggatacaggttcaaaaatggacgaagttatctttgaagagttcaaaggaacaggcaatatggaattacacctttctcgcaaaattgcagaacgccgtgtattcccagcgattgactttaaccgttcgggcacgcgtaaagaagatctactcacaagcccagatgaattgcaaaaaatgtggattttacgcaaaatccttaacccaatgggtgaagtggaagcaatggagttccttattgataaattgatggtcgcaaaaaccaacgatgagttttttgagattatgaaaagatcttaaccatagaaataaaaacggcacttaaagtgccgtttttattatagctggtttgccacagtagcgatatccgcaaacatggtataagaaataatattcaacattatttttgtaatgaatgtcataaaacgtttatcttaaaaactaaattagatccaattaagatttggactgattacgtatctggaaaacaaacctataaacaacttgccgaaaaatatcattgttcaattagaacaattcaaagatatctcgaaaaagcccctaaaacagcattaaatccaccactgtcacgtgatttaaatattattgcagatgtgtaatcagtccaaatcttaattggatttaatttctttgtgaaagaaaaagttttatgactggacgaacaaaagtatctctgaatattatttttctttccatacttttagatattgttcttaaggcaaaaaggacaggtttttattcatatttcaaaaagaaggcttaacgtcttgtactataaggctttaagccactttttagcaacaaatttgtctattacgcctgcaataggcatagcgaccattttgtctaatatgccttaaaaagttgcttacataaaatagtcactaatatttacaaaaatagacacaaaacaacaatctttcagtatattgttaaattttaaaccgattatttaataccatacttctcgcgatattctctcatttttggcaaatattcagtatattgctctgatctttctaagaagctaacaagatcatcaaaatcaataatagagaaaacctgacaatcgtaatcacgttctacttcttggatcgccgaaagttcgcctttgcctttttctttacggtttaacgcgatcatcacgcccgctaaggttgcattattggcttgaatgatttccattgattcacgaattgctgtgcctgcagtaattacatcgtccaccaataaaattttgccttttaatggactaccaataagatttccgccttcgccgtgatctttaacttctttacggttaaagcaacaaggcttatctacatcaaattgatttgctaacgccactgctacagtagttgcaatcggaatgcctttgtaagcaggtccgaatagtacatcatagtcaatttggctggcttggattgctttagcgtaatattcgcctaatttggcgagatctctgcctgtattaaacaatcctgcattaaagaagtaagggctttgtctggctgattttagggtaaattcgccgaatttcagtacatttcggcttaaggcaaattcgataaagtcgtgtttgtattgttgcattgttagtttccttatacttatttgatatatctactcaggcgtaatccactctaccgtccaactgcctgttccttctggcacaagcacatcagttaaatagggtaaaatctttttcatttgactttctaactgccacggtggattaatcacaatcataccgcttgcagtcatacctcgttggtctgagtcagggcgaacggctaattcaatctgtaaaattttgcggatccccgtttcaactaggcctcttacgatacgtttggtatgttggcgaagcaccacaggataccaaatcgcataaacgcctgtggcaaagcgtttgtagccttcttcaatggcttttaccaccagctcataatcttcttttaattcataaggcggatcgatcagcaccaaaccacgcttttcttttggcggaagggcagattttaactgctgaaaaccgttttcccgttttgtcaccacattaggcgttttggcaaattcattgcgaagtagtgggaagtcgttagggtgtaactctgtgagtaacgctctgtcctgtggacgtaattgttgtacggcaagtaacggcgaacctgcgtaaaaacgtagcttatctttgttaatttttttgatttcatttaggtacaaggcaacttcttcggggagatcggttctctcccaaaggcgagctataccttcaatatattcccctgttttttccgcttcgctactttgcaagctataacgccccacacccgaatgggtatcaaggtagaaaaagcctttttctttctgttttaaggcgtgcaaaatgagggttaaaacgatatgtttaaggacatcggcgtggttgcctgcgtgaaaactgtgacgataactcagcatttttattctctttcttgtaaaatggctctattttagcttatttagtcgttttaaactatgcagaaaacgttaaagattgaaaatggttggctgttaaataccaaacaagtaccttcaccgcactttaatccaagaccctatcaagacgatatttctcttttggtcattcattatattagcttgccccctgatgaatttggcggtgattttattgaccgtttttttgaaggcaagttagacccaacccttcacccctattttgacgagattaaagatttacgggtttccgctcactgtttaattaatcgagaagggcaaattactcaatatgtcaattttaacgatatggcttggcacgctggcgtttcttgctttgaagggcgtgaaaaatgcaatgagttttctatcggaattgagctggaaggcagtaataaccagccttttacagaggcacaatatcaaaccttagctagccttacgcgagtgattatgcaagcctatccgcaaattacgcctgagcgtatcgcaggtcacaatcaaattgccccagaacgaaaaatcgaccctgggcagtattttgagtggggatattacgacttactacttaggtatattcttaagtaaacccaataaaaaacgccaataaaatcggcacaaccaaattgataataaagccgaaactgattgcaagaggcacaatctgaatacctcctgatttttgaataatcggcaatgtggcatcaagtgcggtagctccgccaagtcctacggctgttgagggaaagtgacgcataaaaaacggtatcgcaaataagcagaagatttctcttgagagatcgttgaaaaaggcaatgctaccgtccattgccccccaagcatcattgactaatacgcttgaaagggaataccaaccaaaaccagaagcaaaggcaagagctttaattatcggtaaatcaagcagataagcacaaagaataccgccaatcagaccgcttgcgataaaaacgatggaagtcaaaatgccacgagtatttaaaaatacatcacgcagtggaatgccgctgtttctaagttgaaccccgacacagaaaatcattaccactaggacataggtgcttgaatgtaaagggaaatcaaccacatttttagttgaaaagcctaaaattaccccgacaaaaaccgttgcacagagttgtgccgactcaagcaaaaccttccaacgagatggcaattcttcaaggctatgagcctcacgtttgatcgggtaacacttatcaaaaatgagtaaacagacaatgttgcaaaggtgtagaattgcacttaaaccaaatgccgttgctccaatttgtggtagtttggtcgttaattcatctaattgcccaagcgaaatccccataatcaataaaatcaggtataagcagtaaagcgtaatgcgattgacccaattgagtatctgttgatttgtcgtttggaaaagataccctaagaacagtgggacaaaggcgatcattagtccgtatagcataatttctccttttgccaataaagcaaggaatgtaatagataatttaacgaagataaactgtttttatttacagtgttttattgtatcattaagaatacataagcggtcagatttctctcacagtttacaaatataggcgagcaatgaattacaacaaaaaaattattcatattgatatggattgcttttatgcctctattgaaattcgcaataatccaagtttaaaaggaaagcctgttgcagtagggggaaaagctaatcaacgtggggtgctgacaacctgtaattatgaagcgcgtaaattcggcttgcatagtgcgatgtccacttctcaagcgttaaaacgttgcccgaatttaattttattgcctgtcaatatgtcgctttataaggcggtatcagagcaaattcattgcatttttcgccgttataccgacatcattgagccgatctctttagatgaagcctacctcgatgtgaccgcttgtaagcaacattcaggctctgcaacttggatagcccaagccattcgtcaggatatttggcaagagctacaacttacttcatcagcaggtattgcaccgctgaaatttctagcaaaaatcgcttctgatcaaaataagcccaacggacaatttgttatttgccccgaagaggttgcggattttgtgaaaaccttgccgttaaagaaaatttcaggtgtgggcaaagtgacccaagaaaagctggcacaacttggatttatcacctgtagcgatattcaacaagcagatcaggctttgatttatcaacagtttggtaagtttgggcaacgcttatgggatttctgtcacggcatcgatccaagagaagtcgagcctcaccgccctcgaaaatcgcttgcagtggaaaataccttactttctgatcttgatacactcactgaggcggaagaagtggtgaaatcgcactatcaaaccttactctttcggcttcaacgcaactggggcgataagccactgagcgatttaaaaaagatcggaattaaactgaaatttgatgatttcacccaaactacactagagcgaactacagacggtatcgcagcacaccattttttacagctattacaacagatttggcaacgacgaaagggacgaaaaattcgtttgatcggattgaatgtgcattttcctgaagaaaaaattacgaagcaattaaatttatgggaataatttttgtctaatccttgatttttgttaaataatcattatgttaagcattcggtaatcgcttattaccgaataacaacaatttattaactttggagaattatctatatgatgcgtatcgcacttttccttgcgacaaactttgcagtaatgattgtgctagggattattttaagtgttactggcattgctggaaacagtacgggtggaattttaattatgtctgtgctttttggttttactggttctttaatctcattatttatgtcaaaaacaatggcattaaaatcagtgggagcagaaattatcactgaaccacgcaacaatgcagagcgttggttggttgaaacagtgaaacgccaatcgcaacaagcgggtattccaatgccagatgttgcaatttaccactcagctgatgtaaatgcatttgcaacaggggcaaccaaaagtaactcgctagttgcagtgagtacaggtttgttaaacacaatgacagaagacgaagcagaagcagttgtggcacacgaagtagcacatattgctaatggcgatatggtcacaatgactttattgcaaggggtattaaatacctttgttatcttcctctctcgtatgattgcaacggcagtatccagtagccgtaatgacgatggcgaagaaacacaaagtagcggcacttacttcttagtatcaatggtcctggaaattcttttcggcgtattagcaaccatcattgcaatgtggttctctcgttaccgtgagttccgtgcagacgcaggatctgctcaattagtgggtaaagagaaaatgattgcggcgttgcaacgtttacaacgtgttcacgcaccagaagaattacctggttcattaaatgcgatgatgatcaacggtaaagcaaaagagttctttatgagccacccaccgttagaaaaacgtattgaagcgttgagaaatttatagtgaataatatcggtaggggaaggcttccctaccgatattattcactataatttagggtatcgaaaataatctcagccaaagatactgaaattccaggaaccgatttaatttcatcaagtgttgctgatttgacgccttgcataccaccgagatattttagcaacaaatggcggcgtttggctccaacgccagcgattgccactaaaccgctttcggtaaaggctttttgccgttttttacggtgtccgctaatggcgtggttatgggattcatcacggatatgctgaattaaatgtaacgctgggctgtcgggcggtaagtggatttccttgtcccatttgctgatcagcaaagtttctaatcctgctttacgttctacgccttttgctacgccgataagtaatggtttggatttatcccattccactttgagattggcaaaggtttctaaggctcggtttaactgcccttttccgccgtcaataaagataatatcggggattttttcaggcggaagcggtttatcgtaacgtttgagcagggcttgttccattgcagcataatcatcgccccccgtaatgccttcaatattgaaacggcgataatcggattttaacggtccattttcatcaaataccacacaagaagcgactgtttgttcgcccatcgtatgactgatgtcgaaacattccattcttgcaatttttggcaaagaaagcaccgcttgtaaggcttcataacgggtttggatacgagcatcttgcttgagttgcaaagtcagtgctgccattgcgttggttttagcaagagcaagataacggcttttttcgcctcgcaccttatcggtaatactcactttatgtcctgtttgttccgacaataccttttctaaggcttccacttcgctcacggggtgatcgataatgatttggtgcggaatggtgcgatgttggttcatctgcaaataaaactgcccgataaaagtgtcgctcaattcagcaagttccgtatggttcggtacttttgggaaataacttcggctacccaacactttcccttgtcgtacaaacagaatatgcacgcaagcaataccgtgttgataggcaatcgaaataatatcgagatcgtccaagcgttcgttcgatacaaattgcttttctgtgaccgctcgcacctgctgaatttgatctcgaaaacgcgcggcagcttcaaaatccagatcttccgctgctgtttccattttgctaatcaaatgttcgatcacttgctgatctttaccttgtaagaataagcgaacatactccacctgttgatcgtattctcgttgggaataaacgccttccacgcaaggggcaaggcaacgcccgatttgatattgtaaacaagggcgagaacggtttttgtagtagttgtcttcacactggcggatcggaaacagtttttgtagcagatttaaggcctcccgcaccgcccctgcatttgggtaaggcccaaaatactccccttcgatttttttgcttccccgaaagctggctaaacgtgggtgctggtgtttggtgagcaaaatataagggtaagatttatcatcacgaagcaacacattgtatttcggttgattttccttaatgtaattgtgttccaacagtaaggcttcggtttccgaatgggtaatggtggtatcaatatgagcaatttgcgataccaaggcttcagtttttcggctggcaagagtgctacgaaaatagctcgatagacgcttttttaaatcttttgccttaccgacatagatgatcgtgcctttatcatcatacatacgataaacaccagggttatgtggagtatcggcaagaaattgtttggaattgaattttgacataggattgtagggacacactgcgtgtgtccgctgaatatcgtttttgcgtaaaataaagattagacggacacacgcagtgtgtccctacaaagtatttaagattttaataaacttcctttagatgctttcaagtattgcaacatcgaccaaatggttaaaatcgcggcgatatagagcaaagcaaaggcggtatattccatccacggtgcttgtcgccataacaaaccacccaacgccaacatttgtgcagtcgttttcactttcccccaaatagacaccgcaacacttgcacgttcacctaattccgccatccactcacgcaacgccgaaataataatctcacgggcaatcataatgcctgcaggaatagtgatccaccaagtatggtagtattcgaccacagacaccaatgcaatcgcaactaagactttatctgccacaggatctaaaaatgcacctaggcgggtggtttggttccatttgcgagccaaatagccgtcaaaccagtcggtgattgaagcaataaaaaaaatcaacgtggtaatttcagcagaatattgaataggtaagtaaaaccaaacaataaacagcggaattaacgccacacgaaataaagtcagataggtcggaatgttgagtttcatacgttacaggtcgaataagatattccctatattctattataaagtagatgaaagaagaaagcgataatgccataactcttattatttttctaaatagatagataaaaagaataaatattgtagaatacggactatggtagtgaatgaaatgttaatattttctttttcccaacaagaacttaatgccatttatttaagcctaaaaattgccagtatagcggtcttatttgcgttgccttttgcaactggggctgcgtggttgttggctcgaaaagagttttggggtaagcatttatttaatggcattatccatttgccgttagtcttgccccctgtggtgatcggttatcttttgctgattttaatggcaaagaaaggggcgattgggcaatatttgtggcagtggtttgagttttcgttaagtttttcttggaaaggggcggtgcttgcttcaatggtaatggcttttccgttgatggttcgctctattcggttagcctttgatgctattgatcccaaattggagcaggcggcgagaaccttaggggcaagtccattaagagtgttttttacacttcatcttccgctctctttttcggggattattgcaggggcggtgttaggttttgctcgttcgttaggggaatttggggcgaccattacttttgtgtccaatatccctaatcaaacccaaactattcctgcggcactttatacgtttattgaaacccctgacggtgaaatggcggctgctcggctttgtgtgattgcgattgtgatttcgttagttgcgttatttttttctgagttattggcacaacgtcagcaacgtttccaacaaattaagggacagtaatggcacaatctttgcaacttaaagttaaacatcgtttaggaaacttggatttagctgttgatgtggcgttaaatgctaaaggggtgacggcaatttttggtcgctctggggcagggaagtcgagtttaattaaccttatcgcagggctagtcacaccaacggaagggcgaattgtgttaaatgggcgagtgttgtttgatgatcgtcagaagataaatttgccccctgaaaaacgtaaggtgggctatgttttccaagaacatcgcttatttccgcattatcgagttgaggcgaatttaaaatatggctgtaagaggtttgatgaggcgaatttttcacaattagttaaattgttggggattgaacatctgttagatcgtttcccgatcagcttgtctggtggtgaaaaacaacgtgtggcgattgggcgtgcgttgttgagcgagccagatattttgttgatggatgagcctctttcagctttagatttaccgcgtaagaatgagttgatggactatttggggcggttggcaaaaacggtggatattccgattttgtatgtaagccatagccttgatgaggttattcgtttggcggataatttgttgttgttggaagaggggaaggtggttgcttttgataaaacgttgaatgtttggcatagcccagccttttctgcgtggcagcctgaagctcaacggttgagtttacttgagttgcctgtggttgcacaaaatccttaccgtatgcaagggctggcattgggacaacagttgatttgggttacggaacagcctcgctatcaattaggggatttaatgcgaattagcattggtagccaaaatgtttctattaccctgtctaaacctgagcaaagttctattcggaatattctgcaagggcgaatttgtaaaatcgagcctcaatctgaccgctatgatattgccgttgaggtggaagctcaagaaatttgggcgagtattagcttgtgggcgtttgatgatctgtgcttgcaaatagggcagacggcgtatttgcaggttaaaagtgtggtgatttagattagattcttaatttttctatatatttgaatggtattttttatttaccaagctataaaggagtttgataatcaaacaaagctgcatttaaaaatagctattacgaggtcgctgtaatttgcgatagatcaaaaaaatatatattatcttcttattatttgttactatagttgagagtttacactcaattgttactgattatttttgaggaacataatatggcatacacattacctgagttagattatacctatgatgcattagaaccgtattttgatgcaagaacaatggagattcatcactccaaacaccatcaaacctatattaataatgcaaatatcgcattagaggcatatcctaatttactaggacaatgtccaggaaagctgatctcaaatcttgagcaagttcctgtagaaaaacaagtagctgtgcgtaataatgtaggaggacatgttaatcacacgttgttttggaaagggttaaaaactggtacgaccttacaaggaaaactcaaagagaccataatacgggattttggttctgttgaaacattccaagaacaatttgagctggctgctaccactcgttttggttctggatgggcgtggctagtactagaagatggaaagttatctgtagtatcgacagctaaccaagattctccgttaatgggtaaagatgtagctggtgtgtctggttatccaattttaggtttagatgtatgggaacacgcatattacttaagttaccagaaccgtcgtcctgattatattaaagcattttggaatgtggtgaattgggacgaagcagccagacgttttgaatcccaagcataacgcaactgtgagtagtgtatagatgtagcagataaaggtactggtaatttttataaccggattttggggcatggtagacaaaatggttgctaatgaatattttaaattattcttagcaactctttttatttaaaaaatcctttataaacataacattatgtcttttcgttaatcctgcatgatgcgataatttctctttaagttgtccgaataaattttcaagtctatttgtcgttttttcgatatttaaatcactatacttttcataggtaaataatccatataatgtttaaaactatgataagcacttcttacattccgatgtttataaggataataactctttttgttcgatttatctgaccgttcttctaaaacgctttatgttttaaataccaataatgtaagggagcgtattagattagcaagtatgttagtctataaaaatgaaaataactcattgtaaattaaagaaatctatacaaaaaagctccttgaattttttgtattagaagtcactgtccgttctgcggcaaatttgttagagataaatgctaactctgctgcactgttttaccgcaaaatccgcgaggttatcagccatcatttagcacttgaagcggatgaagtatttgacggacaaattgagttggatgagagctattttggtggacattgtgaaggaaaacgaggtcgtgggcggtaggaaaagtatttactgtggtcgtcaatgatacgaagacaacaacgctaatgcctgttatagcaaggaaaatcaagcctgacaactgatacttatcggagctatgatgcccttgatgtaagcgaatttcaccacgaacgcattaaccattcggagctgtttgcagtgaaacaaaatcacatcaacggcattgaaaatttttggagtcaagccaagcggatactccgaaaatataatgggattgaccgaaaaagttttcctttattcttgaaagaatgtgaatttcggtttaactttgggacaccaaaagagcagttaaaaacattgcgaaaatggtgtgaaatttagggctaatctaatacagtcccttaaattattattgaattgatatgttaggtattcattcatctaaaccctcactccaaaccgcttcggcacaataaaaatcgcaggcagtgcaaacaacaccattaaccagaagctacctgtcggcgaaacttgatagactaagccagtgataaaggtgaacaacgccataaaaatacagcttgcaaagctaaaatagagtgcttgtagttttgccatttgttccgttggttgggtggaaaggtagcggatcattgcataatgtcctgctccataagagatcgaatggaacatttggattgccattaaaatagcgatatttgtggtcgaagccagtaagatccaacgcaccattgagccaacggcagataaaatcattaaatggctgattttccacgttttaaataaacggttggcaaagaagaaaaacagaatttctgaaacaactgccaatccccataataaacttgcactttgggtcgaaatccctgctgatgcccagtaaatcgtgctataagcataataagcggcgtgagaagattgaattaaggaaatggcaatcaacattttgaatgtggttggcactttcattaattgcagatagcttaactctgattgggctttttcttctgtctgtacaaaggcttgggtcggtttaactgttaagcctgtgcctagaaagaccagccagccaattaaaatgtcgataatcgcactttcctctagccagccgattaaataacctgcgctgactgagcctacaacaaaggcaatcgagccaaataaacgtgttctgccataatcaatcccgacttgctgttgccaagtggaagctatggtatcagctatcggcattgctccgccgttgaagatatggaacagtgcgattgcagggaataaaatccaaattgtttgtaccccaaaggcaactaaaaacagagtggaaatggcgagccacgttagccaacgagcaagagaaagtagctggttggggtgggtaatgcgtttagaaaaggtcattgcccctaaaaagcggaatagataacctgaagcgattaacaagccaatcattcccgaatcgtagccgtgatggttcaaccaaacaggtagaaacggcaacagcacgccataggcacaataaaagccgaagaagttaaacgacgaccattgaaaaggggtaaattttatcatagggatttttccatctcttctgcacgcttaattgccgcatacatcgcttgttcaacggttgtatttagctcacgttgttcaaataccgccaatgcttgagccgttgtgccgccttttgaagtgacattttcgcgtaaggttgctaaggcaacttctggattttctaccaccatttttgctgcccctaatgctgccgattgcactaaataacgagaattttgttcgctaaagcccattttaattgccgcttcttgcattgcttccataaacttaaagaagtaagcagggctagaacctgtgatagcaataatttggttgatctccgcttccgtatccacccaataacatttgcctaccgcagacagtagctgttctgcaaattgacaagcggtcggatctaccgatttttttgcaaataatcctgcaatgccttcaccaatgagcgatggcgtattcggcattgtccgaacaatgttgtttgctgttggtaacagttgctcaagacgggcaacagaaattccagccgcaacggaaatcacccattttgcactaaaatccacttgagaaaactcactgcatacttccgccatcatctgcggtttaaccgccaaaatcaccacgtcagcttggatcacagcatcgaggttagacaaatccacctgaacgcccattgctcttagctgcgagcggcgagtttcattgtttttattacgagcgataatttgctcggcaggataaccgcttttgattaatcctgaaatgatcgcaaacgccatattaccagcaccgataaaggcgatttttttgtgttgcatttgttcctccaatcatcaaaatcttccagatttattgacatgaaatatccacataccatataaatagatagcaatattattgctttataacattttccatactctgttcatagaaggtaatttcttgcgaagaaaatcaagcattacttgtttaatttatatataaaaatataatttattaatagagaagaaagagagagtatgttagaacttaattcaactataaaaggttattatcatttaaaaatcacatggcattgactaccagaagatacaaatagcattcagtaacaccttaactttaattccgtgaaatatctgcctctaggagctattttctttaattaccaagaagcagataaccttaacattcattaaggatttctctactattacctttttacagattatttaaacgcacatcaattagcatttgatttgcatcacctgctttttctttagcttgttcataagcacttttcgcagccgccttgtcgccttttgcggctaacagatcacctgttaataactgcttacggaaatcccaagcggtgtctttgatttgagaaagtgttgctaatgctgcatcaaactcttttagctgataatccactgtggcaagacgaaaacggatcacgttttgtaatgttgcatctgttgtcgaacctaaagcctgtgttaataacgtttttgttgtcgcaaaatcgcctttatctgccgcttgttttgcttcttcgagttgagcaaataccgcatagcttgagtctttattctccgcaataaatttttgtataagcggtgcgtttttctcaggattttgcaaatagctttccatcacttgttgatagcttgctgatgtggtttgagctacttcaatttggtgtttttgccagtagttccagccaaatgttgcaactgcaactagaaaaattgccacaacaatcggtgtgccattttctttaaaccagctttttgcttcttcaaactgctgttcttcggttttattaagataatcgctcatttctgctccctatgcaaaacgcgttgttaattcgttgattaaatcagcttgggcaatggtcatttgctccgcttcaccaaataggtcttttactaccactttctgctcggcgacttcactttcacctaacaccaaagcaattttcgcccctgatttatcggcacgtttgaattgttttttgaaattcccaccgcttgtatgtaacattgtgcgaagttgtgggaacgcattacgtaaggtttcagccaaacggaatgcaactgccgttgtgccttcacctgaatgaactacataaatatcaacggctcttggtaattgcacatccgggtttacttcttgcactagcaagactaaacgctccaagcccatagcaaagccaacaccttccgttgcgtgtccgcctagttgtgcgactaagccatcataacgaccaccgccacaaactgtgccttgtgcacctaatgctgtggtgacccactcaaatacggttttattgtagtaatccaaaccacgcactaatttttgattgacttcgtaggcaatacccatttcatcaaggattgcacaaagtcttgcaaaatgtgctttcgattcatcatctaagaaatcgtgaagttttggtgcatcgtttaatactgcttgtaacgcttgatttttggtatccaaaatgcgtaatgggttggttgttaaacggcgttcactgtctggatcttgctttaatacgtctaaatgattttgcaagaaagcaactagagcttcacggtatcgagtacgcacttctaatccgccgattgagttaagctgtaaagtgacgtgttcacggatacctaatttttcccataagcgagcggttagcacaattaattccgcatccgcttcagcatttgggatcccgaaaatttcaacgccagcttggtggaattgacgataacgacctttttgcggacgctcatagcggaacatcggaccgatataccataggcgttgttcttggttgtaaatccaaccgtgttcaatcgccgcacgcacgcaacctgccgtaccttcagggcgaagggtaaaactttcgcccgcttcttcgctacgggtaaaggtaaacatctctttctcgacaatatctgtcgcttcaccgacaccacgtttgaataagtcggtagattccataatcggactacgcatttctgtgtagccataacttgcgaaaatatcacggatattactttcaacccactgccataatggtgtttcagttggggaaagatcattcattccgcgtaaagcttgaattgtttttgacacgttattattcctaaattctcaaataaatagattttacatcaataattttatgtggattttaacactatcattttagaacagtatattttcaggcgcaatcattatctccctaaacataccgtaagctctaaaggttggcttcctttatttgatggcaccactcaataatacaaaacgacgatatttagaaaaaataaagagatcctacataggatctcttttgtatgaaaattaagcttttgctttagtgtacttgtgaatagtattaatctttcttacgcagaactaactgacttaataccactaacgcaagtgagaatacaatcataatagtcgctaacgcattaacttctggggttacccctgttttaaccagtgagaaaatcttcaatggtaacacttcatagcttgcacttgttacgaaagaagaaaccacaacgtcatctaacgagatggtaaaactcaataaccagcctgaaacaatcgcaggaagcaacaatgggaataagattttacgcaaaatggtaaattcattcgcccctaagtcttttgccgcttctaacattttcgcatcgaagtcgtttaaacgtgaggataccgtcacaaccacataaggtaagcagaacgtaatatgtgcaaataataaagaccagaagcccaacgctacaccgactaacataaataaggcaagtaaagatactgccattacaatatcaggtgacatcattaccacaaacaacataccaccaacaaattgttttccacggaaacgatagcgatagagtgcaatcgccgttaatgcaccgattaacgttgcgagagtcgctgagaaaaaggctatggtaattgagtttgttgccgcttgagttagcgtatcattgttaaataaacgctcataccagttccagctaaaacctttccagcttaaaccataacggtcagcattaaaggaattgatgattaaaatgatgattggaatgtacaagaatgcgtacacgacaaacataaaaaagcttttcaatacgcgattcattattctaactccattttcttattcatcagtttatttgcacggtagtacacataaatcattaatgccatcaagacagttaatgcaatactgattgcagagccaaatggccagttacgcgtgacaaggaactcacttttaatgatattacctacaagcaatactttcgcaccgcctaataagtctgccacatagaacatacccattgcaggaagcaaaactaataagcaaccagccacaattcccggcattgttaatggaataattactttaacaaaacgttggaacgcatttgcacccaaatcttttgctgcttctaataaacgtccatcaattttttcaatcgaagaatagagtggcaaaatcataaaaggcaataatatgtaaaccaaaccgataatcaccgcaatttcggtatttaatatacggattggctcgctaatcatacccaaagatagcaaggttttgtttagaacgcctttaacgccaaggaaaatcttcattccgtaaatacggataagcgagttcgtccagaatggcaacaccaccaaaaagagcaaaaatggacgatatttcgcaggcaatttcgcaatcataaaggcaaacggatagcccaccaccaaacaaataatggttgcaatcccagccatacagagcgagttccacaatacttgtgagtaaagtggatcaatcaaacgaccatagctttcaagggaaaacgtaaattcaatcagattactactgtctttggtcataaaactggtgaataacaccagtaagttcgggattaatacaaagaaaattaaccaaccgaagataaccgctacagtaatattttgaaatttcttactagcagtcttcatcgtcgagtacaacctcccagccttcgtgccacgttaatgccactttttgtcctacagagtgatccatatgcggatcgtcttcattgaagaactcgctcactaacactttcatttggttatgatctaacaccacattagactcaagggtcatacctttataagtacgatcgctaacgtgtccaatcaccgcttttgcactttcgttttcatcaagctcttcaattacaatatcttctggacgaagcaatactttcagtttttgatttggatgaacaggtaattccgtatgaatttcgcaaatacgaccttccacattggctcttaccgttttttctgtcacacgctcaatcaccgttgcatcaaacacattgatttcgccgataaaacgcgctacgaacaagttacttggttcttcatagatctcacgaggcgagccatcttgttggatcttacctttgttcattacgataatacgatccgacattgttaatgcctcttcttgatcgtgggtaacgaaaataaaggtaatacctaattgacgttgcaactgttttaattcgtgttgcatttctttacgcaatttatagtcaagagcagaaagcgactcatctaataacaacactttcggctgattaaccaccgcacgagcaatcgcaatacgttgttgctgacctcctgaaagctgtgacggcttacgcggtgccatttcttccaaacgcaccatacgcaacgcttccattacacgaggcttgatttccgcttctggcactttttgcatacgcaaaccgaaagcgacattatcaaaaatggtcatatgagggaaaagtgcataactttggaaaaccgtatttactggacgttgctctgcatcaacattcgatacatcttgtccgtcaagaataattgaaccatcagttaaatcttcaaaacctgcaattaaacgcaataccgttgttttaccacagccagacggaccaagaatggttaaaaactcaccgtcattaattgtaagatctaagccatcaataattgttttttcaccataacgtttcgttatagaacgaagctcaataattggtttttgctctaacttttccattgatttttgttttccccctagggcataaattgagaaaatgcaaaaaaaaagctgactaaaaattcagcacctagcaacataataaatatgttcttgaaatagcttgcaatgatatagcgaatggggggggaatgaaagcaaaaatttgcaattttaaggaaattattgaagtatcttctcataatttcagaccaactttgtctaaagttttccatagtaagtttaatattaggcttagatgcattacaaaatcgctagattgttgcataatattattacaagatggaagtatagaaacttaatataaataattattgagtttaattgcataattatgcataataatcaccaagacaagcggtgagaaaccgccttttatttgcaatttaatttataaaggatactggatatggcactttggggtggacgtttcacacaacaagcagatcaacaattcaaatatttcaacgattcattacgttttgactaccgcttggcgttacaagatattgacggctcaattggttgggcaaaagccattcattccgtagggatcatcaatcaagcggaattagtcgaattaattgcggcgttaaagcagttgcgtgcagaagttgcccctaatttagccattgtgctacaagaagatgcggaagatattcatagctgggttgagctacaactgattaaaaaagtcggcgatctcggtaaaaaactgcacacaggacgtagccgtaacgaccaagttgccgtagatatgaaattatggtgtaaagcccaagtactttcactacaagagtctatccgtgcgttacaagaaaaattggtggaaaccgcagaagctaaccaactttctgtaatgccgggttatacccatttacaacgggctcagccgatcacctttgcccattggtgtatggcatattacgagatgttagaacgagattacagccgtttaaccgatgcttataaacgaatgaatacttgcccactaggttcaggggcgttagcgggtacggcttatgcaatcgaccgtgatttactcgcacaagatcttggatttgaaaccgctactcgcaacagcttagacagtgtatctgaccgtgatcacgttttagaacttttagctgcggcttctattagtatgatgcacctttctcgttttgccgaagatctcatcatctttaacagtggtgaatctcactttgtcgaactctcagatcgtgtgacttcaggttcatcattaatgccacagaagaaaaaccctgatgcctgtgagcttgtgcgtggtaaaactgggcgtgtgtttggtgcgttaagcggtttattagcaactttaaaaggcttgccgttggcttacaacaaagatatgcaggaagataaagaagggattttcgatgcgattgaaacatggcaagcgtgtgtcaatatttcagcattagtgttagaagatattaaagtcgatactgagcgtaccaaagaagctgcacagcaaggttatgcaaatgcaacagaacttgcagattacttggttgcaaaaggtattccgttccgtgaggcacaccacattgttggtgaagcagtcgtttatgcaattagccagaagaaagcattagaagagctaaatttagataagtttaaacaattccattctgtgattaatgatgatgtttatccgattttatcgttagactcttgtttgacaaaacgctgtgccaaaggtggcgtgaacttagagcgtgtagctgaagcgattgctgcagcaaaacaaaatctaaatcaataataagaatagggatgtatcgttacatcccttttgtctatataaaaggagcaaatatgacaaaacaacttaccccagagcttgtattggtcgattacaaccaaattccagtacttgaaattgctcacccgaaagtgaaagcgaaggtggctttacaaggtgcgcatttattgagctggcaacctgttcactctgagcaagatgttttttggctcagtgaagttgagccgtttgagcaaggcaatgctattcgtggtggcgtgccgatttgttatccgtggtttggtggtgtaaaacaacccccacacggtaccgctcgtaatcgcttgtgggagctatctcactatcaagtccaaacggatcaggtcaaacttgagttcagtttgtttgatgaaaaccagcaattagaagcaaaaatggagatggaattagggctaacttgtcagttgcgttttacccatttagctcaaggcgaagcacaagtggcattacatagttattttaatgtcaaaaacattgagcaggtggaactgtttggcttaccagaacagacctttaattcccttattcagcaacagcaagcggttagttcgccacgcaaaattgcagaattagttgatgagatttatcgtgctaaccaacaaccaacgctgatccaagatcttggctattcccgtcaaatgatggttgaacatcaaaatgccagcgaagtagtggtttggaacccgtggcataaggcaatgagcggaatgagtgaaacgggatatcgaacgatggtttgcgttgaaactgcacggatttatcaattagtgcaatcaggcgaacaagttagtgtgaagattagcgtcaaacccctgtaatttatgatatgatttaccctatcaagcccgatagggcatttttattttgagagaatagtatgacaatgttaaaaaatgatcgttatttaaaagcattattgcgtgaacctgttgatatgacacctgtttggatgatgcgtcaagcagggcgttatttgcctgaatataaggcgacccgtgcagaagcaggggattttatgtcgttatgtcgcaatgcggatttagcgtgcgaagtgactattcagcctttacgtcgttatgcgttagatgcggcaattttattctctgatattttaactattccagatgcaatgggattaggcttaagttttggagcaggggaaggtcctaaatttgctcgtccgattgagcgtaaagccgatgtcgatcatctgcctattcctgatcctgaacaagaactgcaatatgtgatgaatgcggtgcgtaccattcgccgtgagttgaaaggcgaagtgccattgattggtttttcgggtagcccgtggacattagcgacttatatggttgaaggtggaagtagcaaagcctttaccaaaatcaaaaaaatgatgtatgccgagcctgcgttgctacacgctctgttagacaaactggctgacagcgttattctttacctgaatgcacaaattaaaactggtgctcagtcggtaatggtctttgacacttggggtggcgtattggcacaccgtgattacaacgaattttccttacgctatatgcacaaaatcgtcgatggcttaatccgtgaaaacgacggaagaaaagtgcctgtgaccttatttacaaaaggcggtggtctatggttggaagctatcgctgacacaggttgtgacgcagtaggattagactggacggtagatattgctgatgctcgtcgtcgtgtcggacacaaagttgcattgcaaggcaatatggatccaagcgtactttatgcaagccctgaacgtatcgaacaagaagtcaaagcgattttagctggctttgggcaaggctcaggacacgtcttcaatctgggacacggtatccatcaagatgttccgatagaaagtccgaaagtgtttgtggatagcgttcatgccttttcacagcagtatcacaaataaggataacgaatgagaaaccctattcataaacgtatcgagcgttttgaaacttggcaacatcttacctttatggcgtgtttatgcgaacgtatgttgcctaactttcaactcttttgcgaggtcagtaagcggtcagatgatgctaaaacttttcaaaatattctcaatttagtttgggaacatctgactgtcaaaggggcaaaaatcaattttgaggaccaactcgaaaaattggaagccattattcctgatgtgaatgaatttgatttttacggcgtattccctgctgaagatgcctgccacgccttagcggaagttttacatagcattatcgcgggagaaacgttggagcaggcaatcaagattagccaaatttcactttcgacagtggcagcctacttagaaacacaagcagatcgcagtttaaacgaacaagagcttaaaaatgcccctgaaattcaagatgaattagatgtgcaatggcaagtttatcgtttgcttaacgagtgtgaagaaagggacgttgaactcattttagggctaaaaaatgagattagaacgagtgggattagtaacattgggttaaattttaatcaaaaaatgtgatttagctaacaaattttgcattatttgctttgagaaatgggctgtttgaattaagctacacattgcattttgcaattttatttggcaattaacgccatcttaactgatacacatctttagaggataaaactatgaacaaaactgagttagtcgatgcaatcgcagcaggtgcagatttaagcaagaaagatgctaaagcagcattagaagcaactttaaacgcaatttctgaaagccttaaaaaaggtgattctgttcaacttatcggtttcggtactttcaaagtaaatcaccgtaaagctcgtacaggtcgtaatccaaaaactaacgaagcaatcgaaatcccagcagctaacgttccagcattcgttgcaggtaaagcattaaaagacttagtaaaataattcttttacaaagtgttttgctagaagcctagagaatatctaggcttttttgcgtttatcagattgtgattttccgttacaatagcgatatttgaaatacagataaacaagacaatgaaagcatctattattaataaactagacagcctaagcgaacgccacgaagagctacaagccttacttggcgatgcaactatcatcagcgatcaagaaaaattccgtgcttattccaaagagtactctcagctggaagaagtggttggcacttttaatcgttggaaaaaattatatagcgacatagaagaagcacaaatcttacttgatgatcccgatatgaaagagatggcagcagaagagatcgaagcaaacaaagctgaaatcgaacaacttgaacaacatctgcaaatcttattgttaccaaaagatccgaatgatgaatataactgcttccttgaaattcgtgccggaacaggtggtgatgaagcaggtattttcgcaggagatttataccgtatgtacagccgttatgcagaaagcaaacgctggagaattgaagaattaagtgctaacgaaagcgaacaaggcggatataaagagattatcgttaaaatcagtggtgaaggcgtttatggacagctcaaatttgagtcgggcggtcaccgtgtacaacgtgtaccgaaaaccgaatcgcaagggcgtattcacacttccgcttgtacggtcgcagtaatgcctgaattaccagaaagcgaaatgccagaaatcaaccctgcggatctgcgtattgacacctaccgttcatcaggtgcgggtggtcagcacgttaataccaccgactctgcggtgcgtattacccacattccaacaggtattgtggtggagtgtcaagacgaacgttcacagcacaaaaacaaagccaaagcacttgcggtacttgcttcacgcattgttcaagttgagaaagaaaaacaagcgcaagagcaggcggatactcgccgtaacctacttggctcaggcgaccgttcagacaaaatccgtacttacaactacccacaagggcgtgtaaccgatcaccgcattaacttgaccgtttaccgtttagacgaagtgatgaatggtaaaattgatgagttaattcagccgattattaccgaatatcaagcggatcagttggcggcgttgtcggatcagaattaatctattcttagggggagaaatcccccatattgagatattctctatggctcaaattcactcgcaatggcaattcggcatcacaccaaattatttagccacattagttctggctggtaaaaaaacagcgacttgctctggcaaaatgttctattcccttgaaaatggagataaatatcctgttcaagatgaattgcatactattttagatagccaaaatcagcctttagtgacaataaaattgacggaagtgacttttaataccttaggcaaagtatctgaagcctttgcaattgcagaaggcgaaggctctttggatgaatggaaatcgttacatcaacatttttttagtcaacaattaaatcaaccgattagcgatgaatttgagctcgtatgtgaacgttttgaagtggtgaagatttttagtaaaacctaccaacaatggctcacttttgccgaacaaaccctgcttgaaaacggatcacaggatccgtttttaaacgccaaagccgatgccaacattctgctacaagcggtaacaaaacgttcaaaatctgcaatttttgcttttgccgaaacagaactgaacgaaagcgaactacgccaacttgccgagctacttgctcgccgatccaaaggtgagccgatggcatacatcttgggcgaaaaagagttttggtcgttgcctttggcggtatccacggcaaccctaatcccccgtcctgatacggaacgtttggtagaagttgcgttggaatgggcatacaagcggttagttactcaagaaaaattgcatattttagatttaggcactggtacaggggcgattgctttagcgttagcaagtgagctaggaaaaaaagcggatattattggggtagataaacagcctgatgcggtagaattggcagaaaaaaatcgtcagaaattagaatttgacaatgtccgctttttaccaagtgattggtttgaagccttgaaaaatcaacgctttgatcttattgtgagtaacccgccctacattgataaagatgatgaaaacttaacacaaggtgatgttcgttttgaaccattaaccgcactggttgccgaacaaaacgggctgagtgatttgcaaaaaattatccaaaatgcaccgctttatttaacccaaaacggggcgttaatgttagaacacggttggcaacaagctgcgagtgttcaagatattttccaacaaaatcaatggaatgcagtcaccacattccaagattatggcggtaatgatagagtaacagtagcaatatggacaacataattaacgatattttccaagagattaaaaagcctaaaagcgtggtaaataaagttcagcttcagaaatttctttaccgtgagttagttcgcttaaccttgatgattgacgataatctgtctgaatctcaggtgttaggcttgatgtcagtacttgtcaaaaaagctcgctatgatgtgaatggggaaagtgatgaagaacgtttaaaccaactattaactttagtttatcaagaatggggctttcattgtcatcacgccgagtatttctatacagataacttattgattaataaagttattcgcaaattccgtggaatgcctgtttctttaggggcagtggtgctttatttagcagcttcactgaatttacctctatatccggtcaatttcccgacacaattaattttgcgagctgaattgaaaaatgagcaaggcagaacggaagtgaaatttatcaatccgtgggacggctctgagctaagccgtgaaaaattggaaaaatggctcgaaggggaaatgggctacggcgtagaattaaaccaagagtatttgcgcatagcggaagaagatgagctattagagcggttagaaacggtatttaaaatggctttaactcgtgaaggtaaatatgaagaagcactgcgtttaatcgaatatcgattggctattagtcctgaagatccgtatgaaatccgtgatcgtggaatgattttagcgagtatggattgctatcaagcagcttttgatgatttaagctattttatcgatcaatgccctgacgatccttctgcaatgatgttaaaacttgaaattgcagggcttgagaaacagagtaaggcgagtgttttacattaaatacaaacattctctcccgcttgcgggagagagacagctaaaaatagcgtgaggctatttttagcagagagagggcgcaagcggttagatttggtgaaatatttgcaaagccctctccctccgcaaattctgcgaatttgctccaccctctcccgtaaacgggagagggaaatcatatttagtttgcgaaattattaaggatttcttatgcaacaaaaaacaatctctctcggcaatatcgacattgcaaataacaaacctttcgtattattcgggggaatgaacgtacttgaaagccgtgatatggcaatgcaagtctgtgaaaaatatgtcgaagttacgcaaaaattaggcgtaccgtatgtctttaaggcttctttcgacaaagcaaaccgctcatctattcactcttatcgtgggcctggtatggaagaaggtttaaaaattttccaagagttgaaagacacattcggtgtcaaaatcatcaccgacgtacacgaaatctatcaatgccagcctgttgcagaggtggttgatattatccagctacctgcattccttgcccgtcaaacagatttagtcgaagcaatggctcgtacaggtgcagttatcaacgtgaaaaaaccacaatttttaagcccaggacaaatgggaaatatcgtagaaaaaatcgaagagtgcggtaacgataaagtgattttatgtgaccgtggtacaaactttggttacgataacttagtcgtggatatgcttggttttaacgtaatgaaaaaagtgtcaaaaggttgcccagtgatctttgatgtcacccactcattacaatgccgtgacccatttggcgcagcgtcaggcggtcgtcgtgatcaagtaacagaacttgctcgtgcaggtatggcgattggtttggcaggtttattcctagaagctcacccagatcccaacaaagcaaaatgcgacggtccatcagcccttccgttgtctaagttagaagcctttgtttcacaaatgaaagcgatcgatgatctcgtgaaatcttttgaagagattgatacgtctaattaagtttatctgtaggggcacactacataagcggtcacttttaggaaaaattttgcaaatgtgaattgggagaataaaaatgaaacagtccattcgccacaataaaattatcgaattggttaatcaattaggctatgtcagcacggaagagcttgttgctcaattgaatgtgagctctcaaacaatccgacgtgatctgaatgaacttgccgaaaatagcttaattcgccgacatcacggcggtgcaggtgcgccttctaccagcgaaaatagcgattacattgaacgtaaacagttcttctctctgcaaaaagagtgtatcggaatgaaagtcgctgagatgatccctgatggtgcttcactctttattgacattggcactacccctgaagcagttgcctttgcactactttcccataaaaaccttcgaattgtcaccaataatttaaacgccgctcatatccttaaagaaaaagaagattttcaaattacaattgcaggcggtggtttacgcaccgatggcggtattattggcgaagcaaccgtcaatttcatcaatcaatttcgtttagattactgtattttaggcattagtgcggtagaatctgatggttcaatgatggattatgattaccacgaagtacaagttaaacgtgcgttaatgcgaaatgctcgcaatgtggttcttgtttccgatcattccaaatttgctcgcaatgcgattgtgcgtttaggcgatgtcagagaagtgaattatctctttactgatcgcccattgccaatagaattgcaaaaccatcttattcacagtgatgtcgctgtgcatatttgtaacgaaaaataagaatgaaatcacattttagtcaagacaaatggttggcttatatgcaattaatgcgtttagataagccaatcggtacttttttattactttggccgaccttatgggcgttatttgcagtggcagatggcgttccgcctttgcctattttaatcatctttctgcttggcgtaattgtgatgcgtgcggcaggctgtgtcatcaacgattatgctgatcgctatattgacggtaacgtaaaacgaacatcacaacgtccacttgccacaggcagagccacagcaaaagaagccaaaatactctttgccacactgatttttattgcctttctgttggtattacaattaaacctttatactcttggcttatctgtgattgccgttgctttagccactgtttatccttttatgaaacgttacacacatttaccccaatttgtactgggaatggcgtttggttggtcaattccaatggcatacggagcggtaagtgaaaccttacccctaaagtgttggctactcttttttgctaatcttgcttggacggttgcctacgacacccaatatgcaatggtggatagagatgatgatttacgaatcggtgtaaaatcaactgcaattttatttgctcaatacgacaataaaatcattgccttattgcaagcaactgcattagtcctactcacgatttttggaaaaataagccactattcaaccgcttactttattgcattagggctaactgctaccttatttatctaccaatgcaaactcaccaaacaacgtgaacgagaagcctgtttcaaagcctttttaaataatcactatgtaggaatggggatctttatttcgattttaatcggcatttacaccgcctagtattgaaatagtgttgaaaataaaaacaaccgattgaaaccacacgatttttacttgcaaccttaaccgaagccccctataatgtactcattcagcttgccagtgtggcgaaatcggtagacgcagcggattcaaaatccgccgcccataaagcgtgtcggttcgagtccgaccactggcaccaacattcaattaaaccgctttttagcggtttttttatttcttattttttcttacattttcatacaatagcaccttaccgcacaaggcttcaagctactttctaatttttgaaattgcaaaagtgtggacaggtagtgttttggttttggctgataaattccctttttaactgcaggttttggtgaagtgaatgaaaacctactattaaccactactaactactcaatactagcaggactgataaagtctataaatgactataaacagttgagattgttacagccgtttatttaggtttatgttgatttatacaaaattatacatagaatgtataattatactttcatcatataattctatctaaaatgaaaagaacagaccctttatatttcccaagaagtgaacttgctcaacgccttttgactagcttaaaagatggcattacgcacgcattgacacttttcgcccctcgaagaatgggcaaaactcagtttttactaaatgacattcaacccaaagcagaagatatgggctttaatgttttctatttcagctttatggatcaggcaaatgacagcaaaatacaacaagcctttgtttatgccttgcttgattttctaaacgacatcacacagggaaaaagcaagctaatagatacgctgaaaaacatcaaaagccttgatattttgggcgtgggggtagaattaaatgataaggaagaacaagcacaaatcaaccttagcagactgttaaacgagatcgcagagaagagcgaaaagcctatattgatgttacttaatgaagttcaagagctagcacgaagcaaagggaatgatgggcttattcgttcattaagaacggggctagatgtaaaccagtcaaaaattaaagtgatttttacgggaagcagtacaaacggattaaaggcaatgtttaacgataacaaagccccattctttcattttgctcacgccttgaattttccacatttagacaaagcctttacggactttttggctgatatttattatcaacgcacgggaaaacagctagataaaatcgcattctatcaagcctttgaacgctttcattttaccccgttatatatgcgtgctattgctcaagatatgattattaaccctgatttaacgctagatgaagcgataaagtaccgcctatcacaaatggaagaacaaggaggaattgctagccaatggcaacgtttatcagagatagaacgccaattattgaagctaatcgccaacggtaacggcacaccatacagcagggaaacccgtttaatgttggcggatgtaatcggcattgaagacctgacggcaagcacaattcaaggcaagatcaaaaaactagaacgcaatgagctaatcacacgaaacatagataaaacgttacagattaataacccacattttaaaacgtggataaaggaaatggatagccttgagcctatcaaataggctttatctgttcctgataattaaaaaggtactcccaacggggtggggctttccacggggttgcggcggcgtggttttcggcaatttttgaatttctaagcatcatcatctttgattaaaagtgaatggtgacccataaaagaatggagtacaaaagtgctagtttagctatttttttaattatgactaacacttttgcgtattatgcctgttttttttacacccaaaaccattgccgtatattgaataatccaacccacacacaaggcaaaaaacaaggtgctaatgccgactgttccgcctaagataaaaccaagcacacatactgtcacttcaattgtcgtgcgaactatccctactttccagccgtatttctgacacattccgaccattaagccatctctaggccctgcacctaagtggcacgaaaggtagaaggttgtgctaatgccaaacagtaaaatagcccctatcattaggatgaagcgtgataataggctttcgggggctggcacatattgtacggttaaatcaataaagagagcgatccaaaaaatattgagtagtgtgcctagcccgaaacgtagttgaagtgggatccaaagtagcagtacgataacgctgataatggcaaccactgtgccgatagacaatcccgtttgtaacgctacgccttgtgagaaaaccgtccacgggcttgaacctaaatttgccaacactaataatccatcagcaattcccattagaatggttgccatagagatcacacagagtgaactgggtttaagttgccattgatgttttgccgtccaaggcatttcgggaataggtgattttctactcatagcgtaatgcttccgcaggttcgatttttgacgctcgataggctggatacagtgtgcaaaccaacgataatacaatcgaagaaagtacaatcaccatgacttgttttgaaacaatctctgtcggcaacatcattcccgtagggttaattaagcgaataaaatctcctaagtaaaccgttgctaacacaccaaatactcccccgactaatgcacctattaccccaacaattgcaccttgagccacaaaaatttgtgttatttgtcctttggttaatccttgggtttgcaaaatcgcaatttccccttgtttatcaaccaccattaaacttaatgatgtcacaatatttgaaatagccacgataataatcaggctaatcaataagcccatcatatttttttccattctcaccgcttggaaaaattctcctttctgttcacgccaatcattaaccagccatttatcagaaggaaatgccgaaggtaactccgtgactaaaaaaggatcagttaaaaataaacgaacaccttggctcttgccttcttcaatgcgtaacaaacgtccaaagtcagccaaatttgcaaataaggtataagcactcgcttcattatttgaataataaatatctgaaacagtaaaaagacgctgaacaggcacacgaccaaatggagtatattggctattttctgtaatcatcaaacggattttatcacccacatttagatctaactgattggctaatcgtgaaccgatcaacacattaaaatcgcctgctggtaaccgttctgataaatcacttacttccgttaataacggatcatcgctatttttctcaacgccaattaattgccccgcattcatgccatgctgactttgaatcatcacattggcacggctaataggaacagatttttccacataagtaggcaaatttaacggctgttctttgttccaagcttcatctatgggtgaaataatcgcgtggggtaaggtagaaagcagattgcgtttctgcatattttctaagccattcatcacagacaggacgatcacaagtgccatcacacccaacacaatgcctagacttgcaaggtttgtgaccaatcgaccaaaacggtcgccacttttagaacgccaatagcgaaaggcaataaataaaggagttgttaagttcataaaaattaatacgagtagaaattggtaaaattctaccaaaatctacccgcttgtcttagagatttctgttatatcaacaaaaaattagttaataacaccgcaagccattcttgctccgccaccgccaagtggtgctgggtggtctgaatggttatcaccacctgcgtggatcatcagcgagcgacctttaacttcatcaagctctttcaagcgtggtgcaagtacagggttagttgcattaccatcatgatcaaccgctaaagcaggtaaatcacctaaatgggcttcatcagaccaaggataaccgtgttttttcgcccctttaggatcccagtgaccgcctgcacctaagcctgcaactaattttccatctttctcttttggttcacagcttgggttttcatgaatatggaaaccgtgtaagccgtgtgataatcctttaagatttggggtaaatactaaaccgtaaggcgatttggtaatcgtcactgttcccacatctttgttgccattttgtggatcaagctgctgaactttcacttcaatttgatcagctgaatttgccatagctgaagttgaaaatccgaaaagtgcggttaaagcaagggttaaaactgtttttttcataggaactcctaagttaatcacaaattatttgcctgttttgacaaattcttcaatattatacgccactttattaactaaagttgtgacggctgaatcactcgcccacgcaacatgtggcgtaatcaataaattcggtaaacgttttgccgcttgaataagcggattatcaatcgctggtggttctttgactaacacatctaacgctgcccctgcaattgtgccattttctagggcatcaagtaaagcagcttcatcgaccaaagggccacgacctgtgttaatcaaatacgcagtcggtttcattaatgccaaggtctctgcattaatcaggttttgggtcgtttcagttaatgggcaatgtaaagtaacaatatctgcttgttttaacacctcttcaaaaggggtatagccgtcacgaatagtcgttgcccccttatgttctgcataaagcacattcataccaactaactctgccaaacgcccgacttctgtccctaaacaacctttgccgaacacgccaagggtggagccacgcacgtcagtaatcgggtaatcgacatagcagaactgcccacaggttgcccaacggtcactagtgacttgatcacgatggtagctcattaaactgtgttttaatgaaaaaatcatccctaaaacgtgttctggcgctgtcacactggaataacccgttacatttttcaccgcaatgcctagttcttttgctgcaacgagatcaatattatttgtacctgtcgcagtaattgcaataagcttcagtttaggcaatttcgctaacaactctcgtccaaataatactttgctagtaatcacaatatcggcatcttttgctcgctcgtaggtttcttcagcagaagtacgatcatattcaatccaattatgcggaaaagatggacgtggaatgttgtgagtggcaggaatgcctgtacggtcaagaaaaacgatattcagcatattagctccttgtttgaaaatagaaagtaaaagtgaatatacaacaagcggtgcgttttaacaaaaaatttacgaaacgaatggaatatacagtttgaaaagcgaaaatgtaggacacacgcagtgtgtccctaccattaagaaactttacagcttttcaacaagttccaccgcatagccaatatagcttgcaggggtcatctgttttaagcgatctttctctgcttgtggcaatgccaatccatcaataaattgacgcatcgcttcaccatctacacgtttgccacgggttagctctttaagtttttcatacggtttttcaataccataacgacgcattaccgtttgaattggctcagctaacacttcccagttttgatccaattcatctcgcaagtgttgttcattcacttctaacttgctaattccttttaaagtagctgcataagcaatcaaagcataacctaaacctacgcccaaattacgcaatacggttgagtcggttaaatcacgttgccaacgagaaatcggcaatttttgccctaaatggttcatcaccgcattggctaaacccaagttgccttcggagttttcaaagtcaattggattaactttatgtggcattgtagaagaaccaatttcgcctgcaatggtgcgttgtttaaagtgatttaacgcaatatagccccacatatcacggtcaaaatcaatcacaatcgtattaaagcgagagacgcaatcaaaaaattctgcaatgtaatcgtgcggttcaatttgagtggtgtatgggttccaagttacccctaaagattgaataaactcttggctaaaggtgtgccaatcaacttcagggtaagcggatagatgcgcattataatttcccactgcaccgttaatttttgccaaaatccctaggttttctaactgtttatactgacgtttcaaacgatatgccacgtttgccatctctttaccaatcgtggttgggcttgccggctgaccgtgcgtacgagaaagtaacggaatatctttgtaacgatgagccaattccacaacagcatcaatcacttttttccattcaggcaataaaacttcttcacgagccgttttaagcatcaaggcgtgagaagtattgttaatgtcttcagaagtacaagcaaagtgaataaactcattgattttttgcagttcaggcaaggctttgcacttctcttttaagaaatactccaccgctttgacatcgtggttggtcgtacgctcaatcgttttaatacgctcggcatcttcaatcgaaaaatgttcgacaatttgatttaagtgatcgtttgcgtctttagataaaactgaaacttcgttgatttgtgcgtgagaagccagtttttgtaaccaacgaacttccacggtaacacgaaatttaagcaagccaaattcactgaaaatagggcgaagtgcagtcgctttatcttgataacgaccatcaataggagataacgctgttaaagcggtcagtttcattcagatttctccgtacataaataaaaatcaacttgagaaatgtagcattttttgcaaggaatttcattagttagttgtggttttatcaattttatatcgtattttgatagttttcatacatagcaaaaatagtgaaaagtataatttctagtcactatactgctttactctctcagtaaaactcattagaactaataatttcattttttatatctttataaggatcgtctatgtatttccgaaaatcctcgttagcgttggctatcttattatgtttatcccctattcctgaaatgaattatgcgaatgctcagacttacacggtttcgggcaactcagcagataatcgtggcgaacactttcgagcattgcttaatcaagctaatgatgggatggcgatattattcgtttagaaggcgatactcggttaatacgaggtagtggtttttttagttttaataaacaagtcacaattgagggacaaggaaatcgcctacattttgaaggttatgatttatcattaggaaaagatgtaactttttccaatatgaatttatcgttaaagcctagtcgaggtttagacagtattttcacttcaataggttctaaaaatttagaagcggttccaactttaattgtaacaaatggaaataaattaaccctagataacgttagaacaaatgttgaaagcgaacctacggacactcgcccaattattttgcttgggaatggcgatactacaaaaagtaataatggacatgataccctgatagtaagaaatgctgatccagcagaaactaaactatactcggtaattattgctgatagtaaagatagtggcgctagttcttttcacagcactaccccagtgacgattgagttaggggaaaatgtgaagttagtggaagatttgtatttagcaggggtagataacgatcaatcttatagccgtgagatcaatgtaacgagcgcctcaaattcagtaacaaaaatccttacaggtgaagcaacaaatgtttcagtaacattaaataatgtaaaaccaagttttagcggtattttatccctagaaaatgttaaaaatttaaccgtgacggggaatagccaaattacgttaaataaaaatttatctgttgcagacaatttagttttagctgatcaggctcaaattaatactgtcgcaggtagtgatgggtttgatggttcaatttcgcttacttaggtgatgcgcgtaacaatatgggaaattcctttgttgagggggcggcattaatgggggtggatttacgtttagttgcacctaaacagttctttcctgaacaaacattattagacgaagtcgcagaaatggctacgaaaacaggggcgaaaattacctgtacagaagatgttgcagaaggggttaaagatgttgacttcgtctatacggacgtttgggtatcaatgggcgaaccagaatccgcttgggaatctcgtatcaatttaatgaagccttatcaagtgaatgctgaattgatgaaattaacgggtaatccaaatgtaaaattcttacattgtctacccgctttccacgatgaccaaacccttgtgggtaaagaaattgcagaaaaatatggaatgaacggattagaagtaacggatgaagtatttgaatccgaagcctctattgtttttgatgaagcagaaaatcgtatgcatacgattaaagcggtgatggtggcgacattggcagggtagagtaggtgcaaaagggtgttttaatgctaacgcatgcatggtttcgtgtaaaagggtagaaattccttggttttctggggtgagcttgtcagaaaatttcagggcattcaaatgcacgttactgccgtgactcgcaaatccgagtagggattctttcatttcagaaaatacaaagttaatgcctgttccgtctgctaggaattcctcgctactttcttggaaggtaattttagttttatctgaaatcagtttgagtgagtctcaaataacttgcttattgtactcattaacggcaacaccatttttatattcaaaacctggagtttgcgcttttctagcctctgagcatcattagctaataattgatgagtaaagtgagcatcctcaattgcggttatatctttctgtttagccattcctgtcggtctgattagaagattttgaaacgtttttgaatgcctatcaaaaatttattcaaacctaccactaaacccactatagaaaacaatgccattgttaaaataacaatggcattgagcatgaaattctaatttataggtgctagattaccacacaaaacttacccctcctccaatcatagtatcccgctgagtattactgctaacagacgctcgaataacccatttgccattatcagaaatttttgagtagccaattgcataagctgcttgtccacgatattgtgcactagaaacggaaatcgcacctttacctggtaaatttacttgaggtaaattcgccattgccccagcagatgcaatacctgctcttgcattgacatcaacacgaccaatatctttcgacaattgattaaatccagcattcatcgaagaaaccactgtgttgagctgacgaacattcacaacatcgccctcagcactaccatctccaatgttggtaattctggcaccattcatatttacaactggatttccttgctcatctttacctaaagatactttcgtatcgccattactaattgaagtaatgtcgcttaaatctccagacacgctcaccttgtaaatattctgatcatttgcacccatttgtgaagtcactttcacatttttacccgcttcaacctcagttcttgcggctgctgttgcggtattaattgctgccgcaacttcatcttttgccaatttcaactgtttaacattaacagcgtccgtatctgctacccctttagccacattacccagcaccataggagcttgattcgccaaattcactttttttaccactaatggcttaagcgtaacactaccatctggattttgtgttttagttgagaatttacctctagcattgaccactggaattaacttaatcgaaccatctgcggcaggttcttccaaatagaaattaccgcccatattgataatcgatttaccgtcttccgtagcatactccatcgtcaaaccgctgacactctgtggtcctgttgcacccgctattccttgcggtccttgtggatccactggaccttgcggaccagtctgacccgttaaaccttgctctcctttaggacctgctgggcctatatcgcctttcggacctgttggacccgcaggacctgtcggaccaactggaccctcaggacctgttgcaccagcagggccctgaggacctgctggaccagcttcacctcttggtccttgttcaccctgttcacctttatcacccttaggtcctgctggacctataggacctggttcacccttagcacctgcaggaccttgtggacccattggaccaacttcacctctatcgcccttaggaccagctactcctggagtcccttgttcacctctaggaccttgttcaccctgagcccctgctggacccgcagggccagtgtcgcctttttctcccctagcaccagtagggcctgtcggacctgtcgcaccagtttcaccttgtggtcccgcatcacctttatcacccttaggtcctgctggacctataggaccttgttcaccctgagcccctgtaggaccttgcggaccaactggacccgtatcacctttatcacccttatcacctgctggacctactggacctgggggaccagcttcacctcttagtccttgaatacctggttcacctttaggaccttgtggaccctccggacctcttggtccttgatcaccctgttcacctttgtcacctctaggaccttgtggaccctcaggaccgcgctcacctcgctctcccgcaggaccttgcagaccagcatcccctttctgacctggatcacctttaggacccctaggtcctgctggacctgtttgtcctgttgcacccgcaggaccaactggaccctctttcccttgcggtccttgtggacccattggacctggtgctcctggttctcctcgttcacctctaggacctgtttcaccagcagggccccgaggacctgttggacccattgcacctgctggacctcgctctcccggtggacctggatcacccttagcaccttgtggacctgctggaccaactgcacccgcaggacccgctggtccttgttctcctggttcacctctaggacctggttcaccccgctctccctttggacccgcagggcctggtgcaccatctctacccttggcaatagtattctttgaaccatcagtataagtaatttccaaattgccattctctaagatttgcgtttctttaattaacttaccaagcgtagaaatcttaatatttccgttcgtttgttctaatttaatattatctccggcggtaaaggttacagtcccacccattttgataagatgtgcatcaacagaagtagcttgaccaccgccgctctgttcggtcttcagttgccagcctgcattatttacagcattgactacagtatcaacagttgcaaatcctggtgtcgtccctattgacaatctgccattagttgtagagccaaacgtacctggtttagcggcattatcaattttttgtttaaattcatcggttaatttaaccgtaatcgtatcgccgctagcctcggaagtaagaccatttgcgccttttactttgagcgtacctgcccataaaccaacttttggtgtatctccttctgttttagtattaccttcaatcttcatggtcaaggattgaagctgcgccacgtttactgcatcagttaattgtttacctgctgcaacgttgacgatttggcgtttgattttctcattacccacagaaactgcaccgatagtaatgttattctcaacactttgtgttgatttaaaaccattctcaacagtactgtctgttattatagaatggggttgtctctctccatctacattcccagctatttctgctctcgaaccataacctaacgccacgccaccatcaacaagaacaattgaattgttaccaagtgcggttgctctacttacttggttggtagttgcccgttcacccacagcgacagaacttatgccagctgcagcagctagatagcctaaagatgccgaatgactgcccgctatagaactgctaccgacagccacaccatattcgctatttgaagtacttttcgcaccgattgctacaccttctttaccggttgcttttgagactggaccgactacaactgatccatttccatctgcgcttgattttccaccaattgcaatggcagcatgtccttttgccgtggttttagcatactgttgaaatccgtctacagtctgatattcagtcgtatttaaatcatcaccaccgattgatatggagccatacccctccgcgatggtatctcccccgatagcaacagattgtgacccacttgctctagcagctgcacctattgcaactgtttgagtatgtgtcgctttggcttctctgcctaaggagacagattctaatgctgcatctgcactataaccgattgatatggagcgatacccatacgcgtgggcatctttcccgatagcaacagattgtatcgcacctgctacagcatcttgacctattacaattgcttcattctctatcgcactggatcctgagcctaaggcgatagatctgtggtatcttgcttttgtattataacctatcgcaatagcagtcctaccactagcgtttgagaactgaccaatagtaatagcaccaggcccaacctcactatttctaccaataccaatagaaccatcgtcgattcctcctccagacccttgactagaaccatcttgaagccatgctgctgaacctactggactaaaaaatatacctagtaatactagacttaaaaaacttaatttaaatttatcttgctgtttatctaaaaaataatgtgaggtgcatagttgagctcttttatccgtgtaagtggatgttttggtatgagattttactaattcagatacaacaacccaagcctgttgagcatgactccaaataactctaaatattttattcataataataatcttcttctctaacgctttttctaataaagcatcataaacttttatttacattttcagggtgtacagatgcccccactccattgtaaaaaaaaaaaaaaaaaaaacaacatttacataaaataaagaataaaataacaagcatttttcaacttttattgtcaattatcaaaaaaattagttaatgaaatcgtcttactcacattcttagtgttggctgaatagttgagtattgatatgcgcaccaacggcattggaattaaataatgttcaggcgagtgagagtagtaagctaaatataggagaaaacacactctctatccaaggcaatattaatggaaaagtcactattaacacaacgaatgaaaataatgtgcatcttactgacaataatgtgttagtagctaaaaatggtagctatattgcggagccaaaatcaaatacacctgaaacttccgaaactacaacccaatctccagcagcaccaacaactccaacaacggaagctccaaaagttgagcaaccgtcagaaaattctggctctgaaactacaacatctacgcctgtagaacaaccaacagatgctacagctccaacaaacggacaaacggaaacttcgagtgcatcggcaaaccacaataaaatcacaatcaccactgcagaacaagaaacacagcgaacgattgcagaaagccgttatgccacccttgtatctaactttgcccaattctctgaaacatataaaacccaaacatacggtatggcattatatggtgcttacgaaacagaagagcgacattattttgatgttgcagtgagaatggcaaaagcatctagtgaactaaaatccaatgcttcgcagacatatcatcacaatctctattctgcatcactggcttatagtaaaggttttgaattgagtaaccgctgggaaatcgaaccatatacgcagttattctatactcacctaagttctacgaactatattagaaatggcttgaatgtaacggctgacgaaatcaatagcttagtaggtagcgttgggactaaggcagaatatcaactcaatcaaattttgaatttctatactaaagtcgcaatgcatagagaatttaacgctacacaagatattaatatcattcgtagtgccacagacagagttcaacataatatcaatcatcgtggaacttggacaacgttaggattaggtatgaaagctcgtctaggcaataatactcatttatatcttgatgtagataaattatttggtaatggatataaacaaagttatcaaataaatttaggattagattggaaattttaatttcagttagatcaataagttaaaagcagtgggatttccactgcgtttttaatattatagtagacatgagttgaatagaagtggcttacatcctaatgaacacaccccacatctacatcggcacgggcggttatagcgatacggatttagtcggtacgctctatccgtttggaacggacaaagcggattttttgtcggtttacagccagcattacgacaccgttgagatcaatagtacctttcacgccacgattggctataaggctgtgcaaggtatattaaaaaaggcggaagggcggttaaaattttcggtgaaactgcatcaagattttagccataaacgtaccgctaccgccgagcaagcgcaggcatttttggctgcgttacaacctctgtgtgatagccattgtttagccaatttatttgtgcaattcccgaccagttttgaacgtcagcacgccaatcgttactatctggcggagctggtgtcgtggtttagtgattatccccttgccattgagtttcgccacgccagttggcatacgcagtcggtgcgggattattttcacggcaaggaaaatttgatttggtgtaacgtggattatccgcagaatatcggtttgcctgcctttcaattttatgccaaccaacgcaccgcttacctacgattacacggtcgcaatccccactggtcgaaagcccaatcggcacaagaacgccacgattattgttatagcgaaaccgaattacaacaactggcaacattgttaaatcagcgaaaagcggagtttgatcagctttatctctattttcaaaacacaaccaatagccattcgttctacaatatcgaaagtctgaaaggctatttggcgagctatggatttaaagcaaaagagacacctgagtttttgagtggacagcagagtttgttttaataagagaaatccgtggttatttattagtaatattctacttgtttttcagctatacaaagaagtggagacaaaagtattggagagaattagagaacatgattaaaactaatacttttgcctactgtgccgatttctatagaaaataaaaagacctctgtggttttactaccaaagaggtcctttgaagattttaaattactgttggcacacaccacaagttgcagctgatgagaacatccaaactaatttctcttgctctttgatgtagtcgctcatttgtgacgctgtaccttgatcttctgcagcatttgctaacgctaaaatttcacgttgttgtttaagtaaagtttggaatccttctaaagtacctgttaagcagtgttgtgctgaacttgcaccgatgtcttctttaacaagtgaaacttgtaagtattggctaaatgcgttatctggcgtataacctaaggttaagatacgttctgcgatttcatctactttaaccactaaatcatcgtagatttcttcaaattttgcgtgtaattcaaagaaacttacacctttgatattccagtgataaccacgcacattggtgtaaaacacttggtagcttgctaataaaccatttaactcttttgctaatttctcagcagaaaccttgtctaaaccgatagagtttaccattttttttctcctatataatgtgatccgcgaggcggattataacctaaaaaaataattgaataaatgaatataatttattcatataatagaaaaaatcaatcagtttaatgagaataatttctttttaaaacaattagataggaattatttttatttcttaaataaaagcactcttttttatttaaaatgctctaacccatattgataaagtgcattttttttgtagccaaaagtgtctgcaacaattgcggccgcttttttcagtggtaattcttcacttaatagggagagtaatttaagtgcttgcggagaaaattcttcgctttcatctgcagttttcccttcaacgattaagacgatttcgcctttaatacgattgctatcttgttgtagccagtcgattaattgtgcaagcgggtcaccgtgaatagtttcccaagttttggttagctctcttgccattacaacatagcgttctccaccaaacacgctttgcatatccgttaagcagtctaaaatgcgatgggtggactcatagaaaatgagtgtgcgaggctctgtggctaattcgttaaatttgtcacaacgagctttactttttgctggtaggaacccttcaaaacaaaagcggtcagatgcgatacccgaactgcaaagtgcggtaattgcagcacaagccccaggaataggcacaatgttaataccaacttggcggcaatgtcgaacgagatggaaaccaggatcgctgattaatggcgtgcctgcgtcagaaattaaggcgatgttttgtccttgttgtaatttttcgacaagcacggtggcacgttgttgttcgttatggtcgtgcagtgcgaagaaaggtttttttataccataatggcttaacagaataccgctatggcgggtatcttctgctgcaataagatcgacggcagcaaaagtatttaaggctcgctgagtaatgtcttctaaatttccgattggggttgcaacaatatataatgtaccgatttgtttaggtgagtattcgtttttcatttgattttctcttagttgataagtaagatctgcctaatattcacagactaacttaagtctagataatagccaaatttatggagcaataagatgccaactattttagtacaaagttatggctttcgccaaaaaatgaaaacgatctttattcctactgcccttgctttgttgttggcagcctgttcaggtaataaagtgactgaaacattaaaaaacgaggcttatggtaactctgaattttatatcaataaagccgaacagagccgcaatattgaagaacagcaaagttatcgtttgttagctgttcgcaagttaattgaagaaaataaggttgttgaagctcagaataccttttcagagattttggtagctaaactaaacgatgagcaaaaacttgaacatcgtcttttaattgctcaattagctgcattacaagggaacaattcagaggctcaaggtgtattgagagctttaccacaaacactattaagccaatctcaacgtctgcgtgtgtatcaaactcaagcccgtattgctgaaaatcaaaatgatgtcattgcggcagttaatgcaagagcattgatggatcgctatatgacggatactcaaagtcgccaagcgaataacgacaaaatttgggagatgttacgtaatgctaaccgtggtatgttagaaaaagcggtggcaggtcctggtgaaatcggattagctggttggttagccttagtggttgcttataatcaaaatatgtctaatccagcacaattgcctcaagtgattgaaatgtggaagcaacagtaccctaatcattcagcggcacttttactcccgattgaattacgcaacgtatcttctttcgaacaaacacaattaaatggcgtggcattattattacctttaagtggcgatgcaaaaattttaggtgaaatcattaaacgtggttttgatgatgctaaaggaataacaacgatgccagttcaggtatttgatactgatagcgcacccattaatgatttattaatgcaggcgaaacaacaaggggctcaaactattatcggtccattgttaaaaccaagagtagatgaaatgctaattagtcctgaaattagcaatattaacgtacttgcattaaattctaccccaaatgtaagagctgtcgccaaagtatgctactacggtttatcaccagaagcagaagctcgttttgcagctgaacgtttcctgaaagatggcttacaaaatgcagttgtggttgcaccaaatggcgattttggtacacgttctgcggaagcctttgcccagcgttggcgtcagcttactaacagagatacggacattcgttactacaatcaagcgtttgaagtcgcttctttattgcagggttcggtattaggacaaggtagtggtttgtatgcattaggaacagcggagcaattatctgatttgaaacaaagtttagataactcaccgcttgctaatcagttcccaatttatacttcttcgcgtagtaattcgccgaacaatgggcctgatttccgtttaacgatggaaggggtgaaatttagtgaaattccactcttatccgatccttcatctagcgaatataaaaaagcagagcaaattgcagagagcgatttttcaatgatgcgtttatacgcaatgggatctgacacttggtctattgcgaataaattcaatgagttccgtcaaattccaggttacaaagttcacggattaacgggggtactaagagcaggtccgaattgtaatcttgagcgtgaaatgaactggctacaatatcgtggcggttctattgttgatgccaattaagatgcgttctcaaggtgcatattttgaacagcaagccaaaattttcttagaaaagaatggcttgcggtttattgctcaaaatcagcagttcaaatgtggcgaactggatttaattatgcaagaaggcgataccttgatttttgtcgaagttcgccaacgcaaaaatgcctattttggctctgcggtagaaagtattgattttcgcaagcaacagaaatggcaaaaagcagcaaatttatggcttgcacaacgaaatcaatctttagatacggcaaattgtcgttttgatgttgtggcatttgaaggtgattgttcaccgatttggatcaaaaattttttaggatagtatgttagaaaaaattcaagatcgctttagtgaaagtattcaaattcagattgctgcagcagaattactgccaaaagtattaaacgaagcggctaatcgtatcgtatcttgtttgttgcgaggcaataaagtgatcgtttgtggctatggacgctcttatgccaatgcacaattgctggtgagtaatttgttgcaccgatatgatcttgtaagacctagcttatcggcacatttactgcaatttgatggaatgcttgtgggctgtttaaaccaagatcaagatctcaatgaaatcttccgtaaacagctacaagtgattgcaaaagagggagatctgtttattgcattttccccactaggtaatgaacaagcggtcttgaatgcgatacattgtgcaaataacgaaaatttggaaatttttgcgtttaccagtagtctaaatgatcatactaaagggctgcttgataataccgatctagatattgagatgccatcaattaatgagatgcgaataatcgaagggcatcaattttgcgtgaatttaatctgtgagctggtggataatctgctgtttccaactacatcacactaacattgaaataggagaggactatgttaaaactcgttaaacgcattacccttgcaagcttatttggcttaacatttctatcattacaaggttgtttagccactgctgttgtaggtggagcagcggtcgtaacgaaggttgcaacggatccaagaacggcaggtcgtcagttagatgatgaaacactggaagaaaaagtggcttataatctgaataaagatcaacaacttaacagcgaagctcgtatcaatgtcgtttcttataacggcaaagtcctgctgataggtcaagtccctaatgatttttccaaagactcggcgagtagtatcgctacaggggtagaaggcgtatctacggtttataacgaagttcgtatcggtccaaaaattggggttgcacaaattagcaaagatagctggattaccaccaaaatcaaatcgaaactctttgtgaacggctctgttaaagcaacagatgtcaaagtgattactgaaaatggtgaagtattcttaatgggtaacttatcaagtagtcaagcagatgccgccgccaacgtcgctcgtcacgtcgatggtgtcgtcaaagtcgttaaagtgtttacctacatacaataagggcattgataataaacattaagcatattggtattcttggagccgatatgcttttttgtaaacggaattttgtcaattactttaaagaacattgactttaattgctcattcattaattatcacaagccatttttcagtcaatacactccctttaattttttaagaaattgtatttttaaactagaagaaagcgaatgcgtgagataaaaaatttggttgaagtaaaaaacctcacctttaaacgaggtgagcgagttatttacgacaacctaaatctacaagtccaaaaaggcaaaatcacagcgattatggggccatcagggatcggcaagaccaccttgctacgccttatcggtgggcaaattttacctgaaagcggcgaaattctctttgatggacaagatgtttgccaagcaaacaataaaacgttatatcaacttcgtcagagaatgggaatgttgtttcaatctggtgcgttatttaccgatctctcaacttttgacaacgttgctttccctattcgtgaacacaccaacttgcccgaagaattaatccgtaaattagttttaatgaaacttgaagccgtagggctacgaggggcggcacagctaatgccttcggaattatctggcggtatggctcgccgtgcggcattagcacgagcgattgccctagatcccgatcttattatgtatgatgaaccttttacagggcaagatccgatcagtatgggcgttatcgttgaattaatcaaaaagctcaatcaagcactcaatctaacctcaatcgtcgtttcacacgatgtgaatgaagtgctaagtattgccgattacgcctatattattgcgaataaacgcattattgccgaaggaacacctgaaagcttattagcaagtcaagatccacaagtggttcaattcttatcaggaacagccgatggaccagtgcagttccactatcctgctcaaaattatacggaggagctatttcaatgatggagtttatatcctcaataggtgcttccgttattcaggcgattagagcaatgggacgagccacctttatgttgtggggggctttagtcggtaagccagaatttcgtaaacatacccctttatttatcaaacagttacacgttttgggcgtacaatccttactgattattatgctatcaggcttatttatcggaatggtgctaggtttacaaggatatgtcgtcttagtcgatttctcggcagaaaccagcttaggacagctcgtttctctctcgctcttgcgtgaactcggccctgtcgtcaccgcattgctctttgctgggcgagctggctctgccctcactgcagaaattggcttgatgaaagcaacagaacagctctcaagtttagaaatgatggcagtcgatccgctacgccgtgttatcgcaccacgtttttgggcgggcattattgcaatgccgattttagcggtgatttttactgctatcggtatttggggtggctcacttgttggcgtagattggaaaggggtcgatgcaggtagcttttggtcagtaatgcaaagtaccgtaacaatgagcgatctgcttaatggcttcattaaaagtatcgtctttgcctttgcagtggtgtggatagctctatttaatggctatgatgccctaccaacctcagaggggattagccaagcaacaacaagaaccgtcgttcacgcttcactggttattttagggcttgattttattttaacggcaataatgttcggcggttaaacaagcaaaggtattattgtaaaatagcagacaaaatacaccgcttgttagtgtatttgaataggaaaaattatgcgtcaatcaattaaatatgaattttgggtaggcttatttgtacttcttggattaggagctttagtctttttgggcttacgagttgctaacgtacaaggcttctcttcggaaaaaagctactcactctatgcaacttttgataacattggcggactaaaagtccgtgcgccaattaaagttggcggtgtagtaattggacgagtatctgatattcaactcgatcctaaaacctataccccgaaagtcacccttgctattaatgaagaatttaatcaaattcctgatacaagttctctttctattaaaacagcaggcttactgggcgagcagtacattgcactgaatgtgggctttgtccttgaaggcgaaacagcaatgctcaaagagggggatagctttgctgataccaactcagcaatggtactggaagatttaatcggtcagttcttatatggtgataagaaatctgacaaaacagaagacaccgctgaacctaaagcggaataattgctcacttttaaaatcacattgtggagttttatgatgatcaaaacccttaaaaacctttttattgcaggctttgttgcaatttctgcattcgtttcaaactcggctttggcttctactagcccttatgtcctaatgcaacaaacggcagataaactttttggtgatatcaaagcaaatcaaagcaaaattaagaaagatccaaactatttacgcactatcgttcgtaatgatcttatgccacatattcacgttaaatatgccggtcaattagtcttaggtaaaaatttagcgtcagcgactgatgttcagcgtgaagcttttttcactgcatttggtcaatttattgagcaatcttacgcgcaagtattaacacaatacagcgatcaacaagttcaaattgaaagtgaaaaaccgctagacaacaaatctatcgtcagtattcgcgtcaatgttctacaatcaggcaacgccaagccaatcaaattagatttcaaatggcgtaaaaatagtaaaacaggtgaatggcagacctatgatatgtcagccgaaggtgtgagtatggtcgcaaccaaacaaaacgaatggagcggtattttacgccaacaaggaattgatgctttaacagctcaggttgcacaatctgcaaaacaacctatcacattaaaataattcgggtatgcaaacaaaaaatccattacaatggcacattcagcagaacaatgaaagcctgatggttcaactatcaggtgagcttacccgtgacacgttgcttccactctggaagcaacgtgcttcttttttatctcccaaaagttcgcaacacatttattgggatttaaaaggtctcactagcattgattcctcaggctttacgttactggctgaactacttcaccattatcaacaaaaaaataaaaactgtttatttaatgttccgcaagcggtacacagccttgcggagttatttgatttagcagactggtttaaaacattcctattttgtgagaagaaataacaatggaacctaaacaaattgaagaaatcctaaaaagcgccttagaacttgatgaagtttatgtacaaggtgaaaattcccattatggtgttatcgcagtaagcgacagcttcgccataatgtctaaactaaaacaacaacagatgatctatggtcctttaactgaattttttgcaaccaatgcaatccacgcattaacgatcaaaacattcactaaagaacaatggaaaagagagcgtttgctcaatatgccaagctaatcacatcatctaaaggaattaaaatggaaaaatttcgtgttcacggtcctttcactttaagcggaactgttgatatttcaggtgccaaaaatgcagcattaccgattttatttgcggctattttagcggaagaacccgttattcttacaaacgtccctgatttgaaagatgttgaaaccacattcaaaattctacgtaaactaggtgttgtcgttgaacgtgcggaaaataacgcagtacatattgatgccagcaaaattgaccattatgttgcaccttatgagcttgtcaaaacaatgcgagcttcaatttgggcgttagcccccctagttgctcgtttccatcaaggtcaagtttcattaccaggtggctgtaccatcggtgctagacctgtcgatatgcatattgcaggcttagaaaaaatgggagcgatcatcacccttgatgaaggctacgttaaagcagaagtgaacggccgattaacaggtacgcgtattctgatggacaaagtcagcgtaggtgcaacattatctgtgatgatggcggcaacccttgcaaaaggcacaaccactattgaaaataccgctcgtgaacctgaaattgttgataccgccattttcctcaacaaaatgggagcaaaaattacaggggcaggcacagacaccattaccattgagggcgtagagcgtttaggtggctgtgaacaccacattgtcccagatcgtatcgaaacaggtacattccttgttgctgccgcaatctctggcggacgaattacttgtcgaggcacgaaagcggatacattagatgccgtgattgaaaaattgcgcgaagcaggaatgcaagttgacgtgaccgaaaacagcattaccctcgactctctaggtatgcgaccaaaagcagtcaatatccgcacaatgcctcacccaggcttcccaacggatatgcaagctcaatttacattattaaatgtagtcgccaacggcaccagcaaaattaccgaaacgatctttgaaaaccgctttatgcacattccagagctaatccgtatgggagcaaaagcagaaattgaaggtaacacagcgatctgtcacggtgtcgaaagcctctcaggcgcagaagtaatggcaacagacctacgagcttctatcagtttagttctggcaggttgtattgcaaatggtcaaactattgttgatcgtatttatcatatcgaccgtggatatgaacacattgaagataaactacaaaaattaggtgctagaattgaaagatttaatgcaccatttgaagaataatttttcatataaaacaacataattgctaaaaagtggcctaagccttatattacaaggctttagcccctattttaaaacatgagcaaaaaatctcccattttgtcaaagtttgaaaattaaggaaacatagtatacaaaataatatccaatgttatttggtaataaatgttataaaatttttatcttaaaaaaataaattagatccaattaaaatttggacttattacacatctggaatacaaacctatcaacaacttgctgttaaatctcgttgttcagtcagaactattccaaagatatcaaggttattttccttataaacatcgcaatgtaagaagtgcttatgccagtttaaagcgttatatggattttatttttatctatgaaaaacattctgaattaaatatagaaaagacgacaaatcgctcagagggattatttagtgaacttaagcgaaaattaaataatcacaacggattaacgaaaaagcgtaagatattgtttatacaagactttttaaataaaaagagttgctaacatttaaagaaaataaacattagcaactgttttgtccacttggcgtagtttttgacagatcagcaactattttgtctattacaccaaattatcggttcataatggattaacgaaaaagcataagattatgtttataaaggattttttgaataaaaagagttagttgataattaggggaaataattaaaaccaacacttttgtctatgatcaatatactagcacctgaatattgacttaacttccgacaatagaagggactaacttttattattcatcaaacaagactagttctgttttttctatttctggtggattatcacataaccaatttgctaaacgggcataatccgcaagcgataagttttccgctcgtgcattcaaatctacccctaatgcctctaactgctctacattaaacagcgtagcaagtgcgttgcgtaatgttttacgacgttgattaaaggcttgtgtggtcacacgatttagccagtaaatatctttcacagggtagggtagtgttttatatggcactaaccgcactaccgcagaatctactttcggagcaggtttgaatgctgttggcggcacttccaacacgggcattacttgacaataatattgcgccataatggttaaacgcccgtaggctttgctatttggtgcagcacataaacgcttaaccacctctttttgcaacataaagtgcatatcttgaattaagtcgtggaacttaaagagatggaacatcaacggagttgaaatgttgtaaggtaagttaccaaacactttgaccgctttgccattcaaggctaggctatcaaaataggcacggaaatcaaaacgcaacgcatcttgttcaatcacagttaatttttgatgtaaaaacgggtgatggcgtaaacgttctgcaagatcacggtctaattcgaccacagtaagatgatctacgagatctgccactggctcagttaatgcccccaagcctgggccaatttccaataaaaattgattttgctgcggattaattgccgcaacaatattatgaataacgttttggtcgtgtaaaaagttttgaccaaagcgtttacgagcggtatgccctaaatgtttttttgaatttgaactcattgaataccttaataagcggttatgttcccactaatttttataaatttaataaagtaaagaacctcgcatatgcgaggctcccttaattattagataaattaaaaatattttatatctaatttacttctcaatacttttatccaatcttttgatgccactttcacttgtttatcaacaagctgctcgtaagctttttgtaaataagcatcttccgtacgatctcctctgcgagtatcagtaacttttagtatatgccaaccaaattgtgatttaaaaggagatgaaatcacatcaattttacttttacttgcaatgttagcaaaagttgaatcatagacatctagaaaattaaaaccgagatctcccccatcaataccagatatataatctacagagttaattttcgctgcttcttcaaatgttattttaccagatttaatgtcagcggtaattgatagtaattttgccttagcttgcatatcatttaagattggcgtcgttttaatcaatatgtgactaatgcgatattctgtagcggaaactgtttcaaatgtaccgtttgtttttgctttatctagcatatccttcgctaaagattgaacatctttcggctctacttgaatagaatttccaatactttgttgccgaacttgttctattaaaagctgatgagcaagttgttgacgatactgactaagactaatgccctgataatccaaagcatcaagtagttggccatatgttataccattttgagcagcaacatcttccatcatctgatcaacataagcatagtctacttttataccagattctttaatcgcacgttgcacaacgaaatcatcaataatagtctccaaagccgctttacgattagcttccgtattcgcttttttacccaaagcctgttttacttgactctgcataatgggataaccatctactgttgcaacgactctctcttccgcattagctgaagaaaatgcaaataaagcaaaacctgcgataaataatgattttacttgtgtaaacttcattttaatttcctatgaatattgtagataaaaaattcctgctacttagaaggctattctagcaaaaggttcacaaagatcggattttcttaatcacatttgtggtcgaacaaccgttttcaaagttgagtacacgaacctcgccaccatttgcccaaacttcttggctacctgcaatctcttccggcttataatcgccgccttttaccaataaatcaggcaaaatttccccaattaaacgttgtggcgtatcttcaccaaacggcacaacccaatcgaccgaagcaagcccagctaacaccgccattcgtgcatctaaatcattaatcggacgactttccccttttaagcgtttcactgattcatccgtatttactgcaacaatcaaacgatcacctaacttacgtgcattttcaaggtaagaaatgtgtcctgggtgaagaatatcaaagcaaccattagtcattacgattttttcaccacgagtttttgattgtttaacaatcgccttcaattcatcttcagacacaaccccaaaacctgtttcagcacgttgatgaattgcctgctctagttcacttgggctaacggttgatgtccctaatttacccaccacaattccagccgccgcattcgctaaatagcacgcttcttccaaaggacgaccatctgcaatcgccgttgccagcacactaattaccgtatcgccagcccctgttacatcataaacttctttcgcttgcgtcggtaaatggaatggctcttgatttggacgaagtaacgtcatacctttttctgaacgagtaatcagcaatgccaacaaatcaaaatcggctatcatttttaagcctttagtcacgatttcatcttcatcacgacaatgccctgctaccgcttcaaattcagacatatttggcgtaagcaacgttgccccacgataacgctcaaaatctgtaccttttggatcaattaacacaggcacattcgcttgacgtgcaatttgaatcatttgctgaacggtatcaagcgtacccttgccataatctgacaagatcaacgcaccgtaagcggtaatttccgctgctaattttgcaagtaacgcttgacaatctaaattatgaaaaccttcttcaaaatctaaacgcaataattgctgatgacgagaaagaatgcgtaatttagtaatcgttgggtgagaatctactgcaacacattgattttgaatacgatgttcgcttaatagtttatccaacgcacgccctgcatcatcattaccaactaaaccgtgcaaagtgacaggcacatttaggcttgcaatattcattgccacgtttgccgcaccgcctgcacgatcttcattttcctgtactttgacaacaggtactggtgcttctggagaaatacggttagtcgaaccgaaccaatagcgatctaacatcacatcgccaagaactaatactttcgcattattaaattgcggggaatattgcatcatcataacgtcaatctcttatcttttacttttcttaataaatttcatcaagcgtttacgtttacgcaactggcttggggtcaatttatttttcttaccagcaaatgggttgtttccttcttggaacaacacacggatcggcgaaccaataattttcaaactcttacggaaatagttcgacaaataacgcttataagagtcaggcaatttctcgatttgattaccgtgaatcacaatgatcggcggattataaccacctgggtgagcatattttaatttcacacggcggccatttactaacgatggctgatgatcatccgttgctaattgcaaaattcgagttagcattgatgtcgtcattttcttcgtcgcacattgataggcttcttggattgagctaaataagttgcccacgccactaccgtgcagagcagaaataaaatgcactcgtgaaaaatcaataaaatctaaacggcgatcaagctctgatttcacattgtctttaatatcctgcgataaaccgtcccatttattgacaacgatcaccaacgacttcccagcatttagaataaagcccaatagcgataaatcttgatcagacacaccatcacgagcatcaattgtcagtaaaaccacattcgcatcttggatcgcctgtaaggttttaatcactgagaatttctccaccgctaaatgcaccttaccacgcttacgcacccctgcagtatcaatgatagtgtattgctgaccatcacgttccataggaatatagatcgaatcacgcgttgtccctggcatatcgtaaaccactacacgttcttcacctaaaatacggttagtcaatgtcgatttacccacatttggacgaccaacaatagcaatcttaatgtttttatcgtcagcttcttcttgatcttcttccaatgcttcatctaataatgccgtatcttcttcgttatcaaagtcaaaatcgctatcccattcatcttgctcatcatctgcaacattttcatcggaatcgaccgcttgtgcgtctaatttttccgcaaggggagttaaaacctgttcgataagttgtgtcacaccacgcccttgtgccgcagcgattggttctacttcacctaaacctaactgataaaattccgcaatatgagagtctgcatcaataccgtccgttttatttgcaaccaccacggttgttttatcacgctgacgcaaatattgtgcaatacctacgtccgcaggcaataacccagcacgagcatcaactaaaaataacactacgtctgcttcttcaatcgctaacagcgactgttctgccattttctcttcaacaccttcttcagtgccatcaataccgcccgtgtcaatcacaataaaatagtgtccagctatatttgcgtgaccatatttacggtcacgggttaagccagggaaatctgccactaacgcatcacgggtgcgagttaagcggttaaataacgtagattttcctacgttaggtctgcccacaagggcaacaacaggagtcatattacaacctcatttaaaatcggtttacgaacatcttacgcaaaatacgtacattatatcgtactttaaaagaaaacggagaaaataataaagagtgggtgatgaagagagttagggcaaaatagtaccctaacaaagagttattcttctaatttcaatgctttagaaaaactttgcagacctttaacattgctattttttgccattgcttgcaaggcttgtgttggaatgtgtaataactgatttgtcagtttataactcaattcatttagtactttttcgcaatcctgcccttgttgcaaggcactcaacgctttttcaagtaaatctaaacgaatctcttcagcattttggcgataatgtttaattaaattggttgattgttgctgtttcaaccaaacaaagaaatcttttgcctcctcaataacaatttctttcgcttgctctgctgcctgttgacgttgagctatattctgctgaatgatattttgtaaatcatctacactataagcataaatactatctagttctcccgctttttcatcaatatcacgaggaacagcaatatcaatcaataacattgggtcaaaacggcgttgtttctgtgcttgttcaaccatttctttagtaatcaaaatatctggactacctgttgaacaaatcactacatctgcttgatttaaaccgatttgcaatgcacttaacgaaagaatttgcattggaatatctagtttcaccgctaacatttctgctcgaatatgagttcggttagcaatcataatattttttgccccgtgattaattaaatggcgagccactagttctatagtttcaccagcaccaactaataaaaaacggagttttttaaaatcatcaaaaatttggcgagctaagccacaagcagcatacgcaacggataccgcactactaccgatttcagtttcagagcggactcgctttgctgtagcaaaggttttctgaaatagccgagaaagattggtggaaacgccacttccttgagaatgataaaattcttcactctcttggtatgcctgtttcacttgccctagaatttgtggttctcctaaaattaacgagtctagaccacaagcgacactcattaaatgacgagcagcttcaaggttttgcttgaaataataggcctcgcttaattcctctttatctaattgatgaatttcaacaaaccaattaaaacactgttcacgccaagcaatattatcagggtgttcttcttgagggggaacttcaggctgatggaaataaagctcagtacgattacaagtagataaaattacaacactttctgctaggctttgatcacgaatttgctcaaatgcacgctgacgtttgtcttctacaaacgctactttttctcgcaagctcactgatgccgttttatgattgatacctaatgctaaaattgtcattgttacccacagaataaaaaaggtggaaaccacccaaaaagacggagcattttaatcaatccatgcggttggtgcaaataattgtcttaataggtttgatttataacaagtgaataacattttatgacgtataaagtggtaagatttttttaaaattttgtaaatctaaaaaatccccacgattttggagtgatttcagttataatacttcaaagcagttttacattgtcaaattctgtcaagaaccctttcagttaagcgttatggaggacttatggttgcgattcgccattcacaccggctcgatccgaacaattttgagttggctagttggagtgctgggctacagatgtctcctattacctttgaacaattactgattgcgtggcgatatgcacaggaaaaaatcgatattgaacaaaatcacttgatgtggtttggggttgaattggtcgaaattttgcatagtttgaatatggacgatgatagccttgtcgctgccttacttttccctcttgtgaagcaaaacatcattgatttagtgcagattaaagagcattttgataatgatgtgaaaaatctcgtcaaaggtgtgttggagatggataacgttcgccaacttaatgccagtcacgcttccgatcttcaaattgataatattcgtcgtatgcttttagcaatggtggacgatttccgttgtgttgtgattaaacttgcagagcgaattgtctatttgcgtgataccgaacgcttaagcgaagaagatctggtattagccgcaaaagagtgttctcatatttatgcaccgctcgctaatcgtctaggaattgggcagttaaaatgggagctggaagattactgcttcagagccttacaccctcaggaatatcgtcaaattgcgaaatatgatttaggtgaacgccgtttagatcgggaacaatatattgcaaattttgtcgaggatctgaccgcctgtctgcaagatgagttagagagtgtgcaaatttatggtcgccctaaacatatttatagtatctggaaaaaaatgcagaaaaaacatctgcgttttgagcagttgtttgatgtgcgtgcggttcgggtgattgtgccgaatttgcaagattgttataccgctcttggcattgtacatacacattataaacatttgcctgaacattttgatgattatattgctaatcctaaacctaatggctatcagtctatccatacggttgttttgggccaaggtaataaaaccattgaagtgcaaattcgtacgcaaaaaatgcacgatgatgcagaattgggcgttgcggcacactggaaatataaagaaggtgcaacggctgggcgttcaggctatgaagaaaaaatcgtttggctacgcaagttgctggattggcagaaagatattgccgattcgggcgatgtggtggctgaaatgcgttctcaagtctttgatgatcgtgtttatgtctttactccgaaaggggaagtggttgatttaccgaaaaatgccacccctcttgattttgcttattcaatccacagcgaaattggtcaccgttgtatcggagctaaaattgcaggacgaattgtgccgttcacctatattttacaaatgggtgatcaagttgagattattacgcagaaaaacccaaacccaagccgagattggttaattccaagtcaaggctttgtgaatacagcaagagctagatctaaaattgttgcttggtttaaaaagctagatcgtgataaaaatattccgcttggtaaagagatgttagaagcggagatggctaaattcaactttagccaaaaacagattgaggatttagccctacctcgctacaacttaaaacaaattgatgatctttatgcaggcattggtggcggtgatatacgcttacatcaattaatgcactatttgcagagtaagctcatcaaaaccactgccgagcaagccgatgaagcgatcttaaaacaggtggcaaataaatctcaacagcaacagaaaaaccgtagtggttttgttgtagttgagggagttggaaatctaatgcaccacattgcccgttgttgtcagcctattccaggtgacgagatcgttggttatatcacacaggggcgaggtatttctatacaccgttctgattgcgaacagctctttgatttacgcagtagtagccctgaacgagtggtggaagcagaatggggtgagagctatgcttcaggcaaatttagtttgaccattcgggtgattgcaaatgatcgcaatggcttattgcgtgatgttagcggtattatggcaaatgaaaaagtaaatgtgttaggcgtatcaagtcgcaccgatccaaaacgtttaattgcaacaatggacgttcaaattgagctaaataatgtggaattgttggataagttactaaaacgtattctacaaattgatgatgtgattgatgcgaaaaggttgtcaaactagcataataacttaaaagtagggacgccaagcgtggcgtctctactttgatataatagagatcaaaaactgaataaaatataaaataatgtaggatatttatgcaaaaattagtcattttaggttcaacaggctctatcggaaaaagcaccctttctgtggtcgataataaccctgagcagtatcaagttttcgctttagttggcggaaaaaatgtcgaattaattaccgaacaatgccaacaatatcaaccgcgttttgtggcattagatgatgaacaggcagctgcaaaattaaaagaaaatctcaccgctttaggattgaaaatcgaagttctcgcagggcaaaaagcgatttgcgaattggcttcacaccctgaggtggatatggtgatggcggcaattgtgggcgcggcaggcttattaccgacgctctcagcggtgcaagtaggcaaaaaagtcttgctggcaaataaagaatcattggtcacttgcggacaaatttttattgatgaagctcgcaagtcaggtgctaaattgctccctgtcgatagtgaacataacgccatttttcaatcattgccgccagaagcacaagaaaaagtaggtttctgcccgcttgcagaactaggggtaagtaaaattattctcacggggtcaggcgggccttttcgtacaaaaccattgaatgaatttggtcaaatcaccccagctcaagctgttgcacaccctaattggtctatgggcaaaaagatttctgtggactcagctacaatgatgaataaaggattggaatacattgaagctcgttggctctttaatgcctctgccgacgaaatggagatcatcattcacccacaatctatcattcactcaatggtacgttacattgacggtagcgtcattgcacaaatgggcaatcctgatatgcgaaccccgattgctcacacaatggcatatccaaaccgtatctacgctggcgttgctccattagatttttttaaattaaaagaactcacctttattgaacctgattttgctcgttaccctaacttaaaattggcgatagaggcttttgccgagggacaatatgctacaacggcaatgaatgcagcaaatgaaattgcagtagaggcatttttaaacgatcaaatccgttttacagatattgtcgaagttaatcgtcatgttgtcgaaaatattgcccctgttcaagttaaagaaattgccgatgttctacatattgataaattggcaagagaggtggcgaagcagcatattttacaattttaagagtattataggcaaaagtgttggttttaattatttcccctaattattaccaactctttttattcaaaaaacctttataaacataatgttatattttctcgttaatcctttatgaaccgataatttctgcctcaggtctttaaataatccttccaaccaatttgttgtttttttctatatttaagtgagcatattcttcaaaggtgaataaatatttcatacagtattttaaactagcataagcccctcttacattatggtgtttataaggaaaatatcctttctcattgggatattcagaccgttcatttaaaaactctttatgttttaaataccattagtgtaatcttaaataaaattcatttttgaggcttttttttagccttttttacgaagtatgttcaatgcgagtttgtaatagaagtctttttctgttttgatgacacggtgataaacgacttttttagctcgtgtatccattaaaactaatacaccaaattcacgaccgaagaaggttacatctgcaataatatttatataagtttgttgtaatagaataaattcagctttagaggacttttcaatataacgttgaatagttctaatggaacagtgatatttttcggctaattgtttataggtttgttttcctattgtgtaatcagtccaaatatctattggatttaatttatttatggaagaaaatgttttatgacaggacgaacaaaagtatctctgaatattatttttctttccatacttttggatattgtgcttaaggcaaaaaggacagttttttgttcatatttcaaaaagtgggcttaaagccttgtactagaaggctttaagccactttttaccaacacttttgtccacttggcatagtttttgacgaatcagcaactattttgactactatgccggttttcttcgtagattactgttttttagcccaatctaagaaacgtttttgtgtttctttgtctgcttgttggaaccagtattgaagttgttgttctgtgacattttctccttgcacaacaattttccccttattaactttattggtattatttgccattgttattggcatagttgataatgcaaatttttgtacagcagcaacaccttcaccaatattgtagtttgccaagttattgataatatttgaattaggcataaaaccttctccttttaggaaatcttgcttatatgttagcttttttcctgaaacagtttcaattttgaaactgggtgatttcttaaattgtgctatatcaaattcactatttaaactaggtgcaaggattttaatatcttcagtgcttccttcaaaagtgagaataataggttgagactcaaaaaaggcactatcagaaccagactgatagatactggatatttctactacaacttggtgtagattggtatcatttacctgtaaattagtatttcttcttactttttgtccatcaaaagcaagaaaagttacatttgaagaacccgtgattgtacctgcaaatgccgttgttccagcgataagagctgtcattgcaagggcaattttacctaatttcataacataatctcctaaaagggtataagggtaaaaaaactgctatatcctatgctaaatttgtgtaaatagaaagggcgaagtttcaatcattgtcgattttttattggaattatgataatttccccctgcttaacttataacgagaaaataaaatgagtgatgaacaacatagcgtaactacgcaagataataagtcctttttaaagtcgctatttggtggcttatttcaacaagagccaaaaaatcgtgaagatttggtcgaagtgatccgtgattctgctgagaatgagctaattgatacggatactaaagagatgattgagggggtaatggaaatttcctctctgcgagtgcgagatattatgatccctcgtccacaaattgtatttattgatgccgatcagccattagaggcttgtgttgatgtgattattgaatcggcacactctcgctttcctgtggtacgtggcggtaaagataccattgaaggtattttgctggcaaaagatctgctcaaatacctacgttccgattcggagccattcaatatggcagaaattctacgcccagccgtgattgtccctgaaagcaagcgggtagatcgtatgttaaaagagttccgttccgaacgttttcatatggctattgtagttgatgaatttggagcggtttcgggtttggtgaccattgaagatattcttgagcagattgttggggacattgaagatgaatttgatgaagaagaaatcgaacctattcgtcagctttctcaacacacctacgctgtgttagccttaacagatattgaacgttttaatcagcaatttgcaattgaatttgatgatgaagaagtggataccgtcggcggcttagtaatgcaagcctttgggtatttaccaaaacgaggcgaagaaatcgaattaggcggaatgatgtttaaagtcacctctgccgacagtcgtcgtttaatccaactgcgagtgactgtcagtgatgaacaattagcgttaatgcaacaagagaaacaagacgaatgagagctgtaaaaaaatcgtcatttttaaccgcttgtgcggtcgccttagtttcaagcggaataggaaccctagcttattcccctttcgactattggtttatcatcttcttatctgcaagcggtctgatttggcttgctacacacaacaataagaaaatcgccctatggggaacattcctctgggcagtaagctatttttgtattggggtaaactgggttcacgtgagtatgatccagtttggtggtgtacctgaaattgtcagctatattgctgtcctgttactctcagcttatctggctctctattttggcttattcgcttatctggtacaacggtttaaactggctaatccttggctgcttgcagtcatattcaccgctgctgaatatctacggggcgttgtttttacaggtttcccgtggctacaatttggttatagtcaaattgacagcccgtttgcaggaattgcaccgattttaggtgtagaggggttgagcttttttgtaatcgttatcagtggttatcttgtagcgatctgccgtgatctcgcaaaaaaagcttcatttccaaccacttcctgtgcaactttagttagtctattagcctttgcctttggttcacaatttattcgttttgttgaaatcgatgaacaacaaccgccaacaacaatggcactggtacaaggtaatatcgagcagaaaatgaaatgggatccagcccattttaactacaccgtaagaacctatcagcaactgatattaccgttacttggtaaatatcaggtaatcgtcttgcctgagtcggcaattcctgctgtagaagctcaaattgaacctttactacaacagttacaaaccgttggggctagaacaggcagtgaaattattattggcacgctacatcagactccaacggagttatttaacagtgccactgtgctaggcaatccgcaacagccatattcgctggaacaatcgcctcgttacaataaacatcacttggtgccttttggcgaatatgttccctttggcaatttgctagattggatgagggaagtctttgttttacctgtaaatttatcgcaagggacatttatccagtcgccactacaagcggctaacagagcctttaatttagcgatttgctacgaaattatcttcaccgatcaagttcagcaaaatcaaaaagctcaccaagccgattatcttctcacgatttccaacgatgcgtggtttggcacgagtataggtccttggcaacattttcaaatggcaagaatgcgagctttagagctaggcaaaccgctaattcgtgcgacaaacacaggcattaccgcctttgtcgatgcctacggcaaagtcaccgcccaagctccacaatttgaagccaccgccttaactgccagcgtgcctgcaatgaaagggcaaacgctgtttgctcaatatggtaatcacttgctgtatgcgttttgcagtgcggtattgttgttgggggtaattgcaagaagaaaataatgggcatagtagacaaaagtgttggtttttttacagactatgccaacttaagaagaaattatcacatcatgcaggcttaacgaagaagcataaaattatgtttataaaggattttttaataaaaagagtttctaagaataattaaaaatattcattagcaaccattttgtctactatgccccaaataatgagggtgggataccccaccttaatattaaatatttcctccaatccctttaaacttctcgataaaggcagaaattttttgaaataccgcctgttttaatgtgagatatttaggattaagtggactcattttaggtagaatggcatttaaatccgttccgttttcacttgcatattctcgttttaatgatgtgctaatataacgcttagctgcttcttcatttaattgctctgcttgaattaatgcttgagcttctcgctgttgctccttctgagcaaactggaaaaaggcttcaattatgctggctttatctggaatattgtcaaggtttgtttgattaataaaatcaacgatcaaactttcttttgctcgatttcctacgctagagcgaataattcggcgaatttcgttaattaatgttggcttatcttttgtttttttatgattttcgaaaactagctctaaaatataatcaagattgatttcttgtgatttcaatagatcgacttcaaatactacatcatcccaatcaatggttgtcttgtccttatcatcgcttgttttttgcttgcgtagccaatcccgaatatcattataagttgaacgataatcttgaataactctttctgacgggacagttacaccagcattataggctccgctaggttcttctactccatcaacaatattcgttttttcaccttgagttaatgcgtgaaattcatcgtaattttgtaaaatattttcaaggcgaagatactcgccaaaaagtttcacaaactctttcttatcttgttccgtttcgatttttgctggatctgggaagcgagtttgcaactctttgacgactgaccaataaccccgtttagcttcgccagtagcttgatcgatatagccattcatatattcctgatagcttttctccaaaaccacattacgagtattgctatctccaaataacgtaatcgtatcaatcgttgcttgttctaaatcacggaacgtaacaatattcccgaatgttttggttgcatcaaaaatacggttagtacgagagtaagcttgcagtaaaccatgataacgtaagtttttatccacaaataacgtattcagtgtcggtgcatcaaagcctgttaaaaacataccaaccacaattaataaatcaatatcttgattttttacccgtttcgctaaatcacggtaataattctgaaattctttaccttctatgctataggtcgttttaaataactgattgtaatcgtgaatagccgtagttaaaaactcttttgccgatgtattcattgcggtaggttcaaaggtttcatcttcgatatcccctatggcatcttgcgtttcattagctgcaaaagaaaagattgttgcaattttcagtggtttttcgaccgcttgttgttgctgtttgaaactttcataatatagtttagcagcatctacactactgacagcaaacattgcattaaagccttttcccgttgcgtttaggcggtgagttttctgtttgaaatggctcaaaatatactgcgtaatttctttaattcgttctgggtgtaataaagcttgtttggtttcaagtgcggtgagttttttctcatctttttccatctcaacatcacggaattttggtcggacattgttgtaatccactttgaatttcaacactttttcatcacggattgcatcggtaattacataagaatgtaactctctaccaaaaacgctggcggtcgtttctgcacctaacgcattttctgcaaatataggtgtgcccgtaaaaccaaattgacagaatttcttaaactttttcttcaaattcttttgtgcttcgccaaattgtgagcgatggcattcatcaaaaataaacactacaggttgttgataaatcggcagattatcttccgatttcattaggttgtttaatttttggatagttgtgacaataattttattatcatctttttcaatattccgttttaacccagcggtactttcagagccatttacactgtcaggtgaaaaacgttgatactctttcatagtttgataatcaaggtcttttctatccacgacaaaaaagactttatcaataaagtctaattcagtggcaagacgtgccgccttgaaactggttaatgttttaccagaacccgtggtatgccaaataaatccgccactttcggtattattccaatttttcgttaaataggtattgtttattttccataaaatacgttctgttgctgcaatttgatacggacgcataatgagtaaattattactggtatcaaacacagaatatttggttaatacattaagcagagtgtttttttgaaagaatgttgcggtaaaatcttttaagtctttgattaaagtattatcagattttgcccaattcatcgtaaagtcaaaactatttttatctcgtttggtcgtattggcaaaatagcgagtatctgtaccgttagaaataacaaaaatttgtagatatttgaataacgaattttctttattaaaactttctttactataacgatgaacttggttaaaggcttcccgaattgccactcctcgttttttgagttcaacttgcactagtggcaatccattcactaaaatagtgacgtcatatcgattactatgtgaaccagtctgttcaaactggttaatcacttgtaaacgattgcgggcaatatttgttttgtcaattaaatagatattttgaatgcggccgttgtcaaaaacaaagtcataaatatagtcattatgaattttacgtgttttatcaataatattttcagctggtttatctaaatattccgttaaaaaacgttgccattcactatctaaaaaagagatattatttaattgttgtaattgctcacgagtattgctcaataatctttcaggcgtggtaatatctgtgcgatattcataattgaaggtttgtaaatcagcaataaactctcgctctaaatcagcttctgtttggtagcctaaattaggttgttctatcttggtatatttatcaagaatgataaagttgttggtttctgtgatgagggtggtttcagtggtcatatattcaattttcgctttgattaaaatggtacgtgttattaatttcttgcattaaatactgtaatactcgcttatcattatctgttaattcaggaatttcctctccagagaatttagaatggctagataaatttatgattctcgataaatatggatttgggctagaacttgaatccttaggcaataattctccccaagtggaataccctaagaagattgatgttttttctagaagatttctcaaaaaattaaaatggtattttttaacttgccctgtttgtattgcattttctatttcatttttaagaaatagatgatatgcaaaaggggaatcattaccttgtatcgctaaactatgactgccatcctctaacttttctagcctatacctttcaaactctttctttttatatcccaatgatttgttatcactattcaattcattatgtaatatattatagaataatggattatgggtagtaatgacgaactttaattctgatttactacattttatcaaataagcaatatctaccgccaactcaatcagatgattttcatctaatgagctaactggatcatcaataaaaatatattctagatcattaaaattaggtgtctcacgttcatcaacttccgccacattaagcgtagatataacttgctcaaagatactatagaaaatactccaaattaaacaactttcctctcctttagagatttttatattatcttctcgaatttcatttcccctttcaaatgaaaacgttatttgtgaatagtctttattaaaatttggggtgagtttgtcattagtataatgctgaaaagatttcgctatgtttctgtcttgcccttgttcttcaaatatccacttagtaaatgcattaggctgtatatgtaatactggattgctatcttcagttaaatcattatcccaataaaacagatcttctgtgaatgcgctgtaataaagtatctttttattgtgaaatccataattatcaacatcactatctttaggagatactaaatgctgaaattttttagataaacgagttttcccagtaccattgaaggcataaatcaattgcacttttttcgttgaagttttaagctcctgtgcaatttcatctaatgttttacccattttttatcctatatttatttggggaaagttaaaagttgttctcgataatattcatactgttttcttcttaattcaatctcttttggtaaaccttctgcaatagaattggttaaagtttcaaatttatctaaaattgctacgatacgctgttgttcttcaagtgagggaacaggaatttttattttatataatatttcttgagttaaacttggtcttcctgaacccgtatctaatttttctagatcaatagttttcatatagtgataaaaatacttaggtataagctcattaatattaatttcagtgtaatagatagtatctacattccaaaaaggtgtttcaacataaaaaatatttgtaatactcccttttcttggaattagaacagtaggtttatcgtaagaaaatgcatcaacagatgccataattccacctgaaccatatactggaatgcttcctttttctaattgcttccaatctttcccatttttgatttttacaacctcccccaaagccttaaataccacttccttattgtgcaataaggctttggtaatggagttagtctcgtacccccctttatcagaaatatcatcaaaattcaataatttatctctaaaatattgatattgtttttgtcttgaagtaagctcggctgtaagctcggctgtaagcgaggtaaatgcgtccaaaattctgactatttctagttgtacatcaataggaggaattgggaatggaaattttctaaagccaaccatatcaactgcggcaaaatttgaaattgtcgtattttttttacaccaatcgcttaataagaagcaataataaaatataaacttactgtcaactctattagtgaaattttttttcaagcttatgtttgtaaatctctgattagctaaatatggtactgttattaaggcgtgttctccaattgttgccgacgtagctataataatggaattagctggaaataattttccacctttaatagcatgaacagaaaccttttgtaaggcagaacttagaatctgaccattttcacgaatatcctccattctaaaccaaggaatagtaccattctcccaataatctttattggattttgaaggagtatatccattttttaaatcaaagatgtcttctaaggcgaaccactccacctctctaccattcaacaacttttcaataaaacgactttctatcatgttaaacctcgtaggatgggctttagcccatcatttaaccttttattttccgatgagctaaagctcatctcttacttttctatattttgcaaatttttactaaaatctgaccgcttatcacattactttagtaataacccttgacctttggatcctgagttgtataattcgcctcaataactccccctactttgccaacccatgaggttggagccacaaggttgggggctttctttttttaggattttttccataaatcccaatgggttaaatcagaaatcatgcccatttgttgcaacgttaccgcttgattttctgtttgaggaaattcattcaataatgcgagaaaacgttctccccatgttgaatttggacagataacatccaacattcttttcattaaacagaaataaacaaaaggcttcgcaacatcaaattgcttccattgtgcttcctttaacccttttaaatttgctttaaagataatgggtttgttccataaacggctatgatgagccgatacattgcgaataaagttaaaggcgtgcaaatgggtttgtagatgtttcccatcttttaaatgataaatttttgcaatgtgatctttatctttctctaacatgcctttatacaacatcgacattgttccaaaatcccaaacttcacaagctgcccaaataggtaagtcgccgtaatgttctaaatgatgtttaacaaaactgctttcagactccctgtcgattaaactttgatatttattcaaccaactttgatggttgaagcatgggtcaacatattgggatttttgatatgccaaagggtcatattgacctaacgtgtaagcaatatttactcttagtgcaatttcaatccgttccaatgcatctagggcaagttgccttaactttttatcaaacatatagagctgctttacatcttcaaagcggctattgggtataaactgatcaaggcgctttttagtattatgtgaatcaatttgacggaaagaatataaatagccacttaaacgataatagccaatactttttaaatagcctaaggctttcttttcatcgtcaacaagcagacctctaccttttagtatctccagttggtcattgaaacttttccatattttttgttgtttcatttatcactctagaataggctttattgttcaatttctgcgatgatagcatcaatttctgtacgcaagcggtcaatattggcaactgttttgcgaatttcagcatttagtgctgtgatgtcgataacttctcgtgtatcttttggttcaacataagaacttacggcgagattatattcgttttcagcaattttctgattttcaacggattgagcaagatgaggtacatcagttttttcgctaaataatttaatgatttcagcaatatgctcatccgttaaaacgttattattcgtttctttcttaaatagactgcttgcatcaataaattgggttttgttatctggtttatgttttgaaagcactaaaatattcacggcaattgatgtgccgtaaaataaatttggtgcaagagcgatcacggtttctacatagttattatcgacaaggtatttacgaattttttgttccgctccaccacgatagaaaataccagggaatgttacaatcgctgcacgtcctcgagtagagaggtagcttaacgcatgcaaaataaaagcaaagtctgctttagatttcggtgcgagaataccagctggggcaaaacgttcatcatttatcaatgtcggatcttcatcaccaatccaacgaatagagtaaggtggattggatacgattgcatcaaatggtttatcgttttgaaattgtgggtcgagcagtgtattgccgagagcaatatcaaatttatcgtagttgatgttgtgtaaaaacatgttcatacgagcaaggttgtatgtggtatggttaatttcttgcccgaaaaagccatcttcaatgacatgatcatcaaattgcttttttgcttgtagtagtaatgagccagagcctgctgcagggtcataaattttattaacggttttttgtccgtgtaatgccagctgagcaataagtttggaaacattttgtggcgtaaaaaactcccctccagattttcccgcattagcagcataatttgaaattaaaaattcgtaggcatcgccgaaaagatcaatgtgattatcttcaaatttcccaaaatcaagttcttccaccccttttaatacagcagtcaaacgtttatttttatcggcaacggtattacctaggcggttacttcgtgtgtcaaaatcagcaaataagcctttaatatcttgctcagacggataaccgttcgctgaattttcaatatctgcaaaaatctctgccaattctatattcaatgtaggattggtgtgtgcatctttaacaacattctcaaacagttggctgggataaataaagtaacctttacttttgatcgtatcgtctttgatttgttctaaaataggatcgtcatctgaaaactgagcgtaattaacactttcatcgccttgttcaatataagccttaaagttttcactgataaaacgatagaaaagtgtgcctaatacatattgtttaaaatcccaaccatctacagaacctcttacttcattagcgatctaccaaatacggcgttgaagttctgcacgttgctgaatactgattatcattttaaaactccactaaaatagggtattatttacaactgaacgttattatactgaatataggcatattgttttttagtataggaagatatgtttattatttttgcaaatttagcacaaattttaattaatcaaactatttttatgaactttaaagaaatatcgcacactaacaagcgtgcattcaagaaaaataaaaacagcgtagaagttaggagaacgcaaaacgatgagtgagcaaagagccgatcaagaattggttgagcgtgcacaaaatggtgataagaaagcgtttaatttactcgtcgtgcgttaccaaaatagagtagctgggttgcttactcgctatatcgcaagagacgatattccagatattgtgcaagaaacttttattaaagcctatcgttcattaaatgctttccgtggggagagtgctttttatacttggctttatcgaattgctgtaaatacggcaaaaaaccatttaaccgccttaggcagacgaccaccgaaagaagatattttagctgaagatgcagaagtttatgatggtggggtgcagttgcgtgaggctgatacaccagaaaatttggtgttgtctgaagaattaaaacgtgtcgtgtttgacacaattgaaaacctacctgatgagcttaaaacggcaattacgttgcgtgagcttgaagggctgagttatgaagaaattgcagaaacaatgcaatgtcctgtgggtacggttcgttcccgaatttttagagcaagggaagcgattgatgccaaaatcaatccgcttttgtagcagaattaaaatactttggagttatctatgcaacataaagaaacactttccgcctatatggacggacataaagaaagcggtgatttcgctgaaactttatgcaatagtgctgagttacaaaaaacgtgggcgaactaccatactattcgtagcgtgatgcgaagtgaagagcagattttgggtagtgatttctctgcaaaaatggctgcgttgctcgaaaatgaggagattgaggcggtggctgaagctcaacaaagtgagaaaccaagaggtatgttactcaaattgaaacgctgggcaacaccgttaatgcaggcggggattgcagcttctgtctgcttggtagccgtttggggtgtgaatatgatgaacagcagtgaggaagtggctcaagtggagcaacctgtattgcaaaccttgcctttctcaaattctgtacagcaagtaagctataatgcgccagccaaagatcagccgacagctgaacatttggagtatcagcaacgccgtattaatgtgctgttgcaaaatcacgagttacaacgtcgtactagtgcaggaaatgtgactttaacggaagatgagaaacaaaaagcacaaaactcttccattcaagtgccattacagccacaagcacaacctcaaaataatcagtaactttttatcactcgaaggggcgttttaaacgcccctctattttttaatatgcctatggaaaacgaaatcgaactaaaaataatgctactgcctgaaaatgtgccgatgctaaagcagtggataaatgctcaacctatcttagaacaaggaaaagagctgttaggaaatacctattatgatagccccgatctcttttttgcgaacaacaaaatgggattacgggttcgtcatcaaaatcagcaatatgaattaacccttaaaatgaaaggcgaaattgtaggtggattgcatattcgccctgaatataatctagcattgcctgatgctcagccagattttaagcggttagtttctcactttaatttaccctttccgcaagcagatttattagacagtcaattacaaccaacctttagcaccgattttgtgcgagagaaatggttgattacaacgccgacggctcaaattgaaattgctctcgatcaaggcaaagtgaaaaatccttttggggaagaagccatttgtgaagtggagtttgaattaaaacagggaatgctagcggatttaattgcatttttagacacattgcctaaacaagatggaatgtggtttagtagcttgagtaaagcccagcgaggctatttggtcggacagcctgagcagattgcaaaagagatcgataaacttaccgcttgtgatatagcacaattatcagaaaaagcccgttatcagttagagcaacagttggtggacttttggcgactaatgcaatcgccgaaattagccgaaaaattagcgacgctatatcctcagcaagcaatggaatattttacagggtgggagtacttcaagaggaatttggaaaagttgaatgtttggatttaaaaatggctatataattctaataatcttcctcttatagtaagtagtagagtaaataattggcatagtagacaaaaagtgttggttttaaaattatttttctaattaccgctaattttttgtctactatgccgattgttattgtttactgtatcaggtttatctattacatcgaaataaaccagggctgagtcaggaaataccatcaccagcccttttacattcattttttataacataggatattaactcctacgtataaagcagctatagttttggacctgctgcaattaatgctttaccttcatcgttggttgcatattgctcaaagtttttcacgaaacgacccgctagatcttccgctttcgcttgccattgagctttatctgcataggtatcacgagggtctaagatcgcaggatcaacaccaggtaatgcttttggaattgctaaattgaagattggtaatgaacccatttctgctttttcgatagaaccatctaaaatcgcatcaatgataccacgagtatctttaattgagatacgtttaccagtaccgttccaacctgtattcactaagtatgcttctgcacctgatgcttccatacgttttactaacacttctgcgtattgtgttgggtgtaatgataagaatgctttaccgaaacaggctgagaatgttggggttggctcagttacgccacgctctgtacctgctaatttcgctgtgaaaccagataagaagtagtatttggtttgctctggagttaatttagatactggtggtaatacgccgaatgcgtcagcagttaagaagattactttcgttgcgtgacctgcttttgatactggctcaacaatgttatcaatgtgataaattgggtaagaaacacgagtgttttctgtttttgaaccatctgcgaaatcgattgaaccatcttcacgaactacaacgttttctaataatgcgtcacgtttaatcgcacgatagatgtcaggctcgttttcttctgaaaggttaatagttttcgcatagcaaccaccttcgtagttgaatacgccatcgtcgtcccaaccgtgttcatcgtcaccgattaatttacgttttggatcggttgataatgtggttttacctgtacctgataagccgaagaataccgctacatcgccatcttcacccacgtttgcagaacagtgcattgatgcaatgccttttaatggtaaccagtagttcatcaatgagaataaaccttttttcatttcaccgccgtaccaagtaccgccgattaattggattttctcagtaatgttgaatgctacgaaattttcagaatttaagccttgctctttccagttcgggttagttacttttgaaccattcattaccacgaaatctggtgtgaagttcgctaattcagcctctgatggacggataaacatattttttacaaagtgtgcttgccacgcaacttctgttacaatacgcactgcaacacggctgtctttgttcgaaccgcagaatgcgtcaataacaaatagacgtttatttgataattggttggtaacaagttctttgatactttgccaagttgattggctcattggtttgttatcgtttttcacttcgtcgcttgtccaccaaacggtatctttggtattttcatctaatacgatgaatttatcttttggtgagcgacctgtgaaaatccctgtatcaacagcgaccgcacctgaagtcgttaaacgtcctttttcaaaaccttctaactcaggtttcatctcttcttcaaagagttgttcataacttgggttataaacaatctctttaacgtttgtaatgcctaaaagtgcaagttcttgttcaacacgatttaacataaattcacctcatatatgattaaagattaaaatttaaaaactggagagattatagagtaattatccaaaaaaaatgttacatacttcaaatttttgagaattgataaaaaatttttttgatctagattatattttttgtaattcggggtagaatagttcatcttttttattgaatggggtaaaagaatgcgagttttagttgtcgttttagcacttttattaggtggtttccagtatgcgttttggtttgggcaaaacggttggaatgaataccaacaagctaaacaagaagtcactcaactgaaagaaactaatcagaaactgaccgctcgtaatcaacttattcaagccgaaatcgaagatttaaaaacgggtatcaatgcccttgaagaacgagcaaggcttgatcgtgaaatggttaaaccagatgaaacgttttatcgcatcgtcccaagagagcaacgttaatgaatagcaagagaaaaatcattgcgatcattcctgcttctggcgtaggtagccgaatgaatgtggctgtgcctaagcagtatttgaccttgctgggtaaaacgctgttggaacatacgctacaaccttttcttgaacaccctgcgatcagccaaattattgtggcggtatctaaagaggatcgccattatggcgatattgctctgcttaaatccgacaaaatccagattgtgcttgggggagaaacacgcgcaaattcggtttttaatgctctcaatgctatcacagatgaaaccgcttgggcattagtgcacgatgctgctcgcccttgccttaagcggtcagatttagacaaacttttgcagattgaagataatcaaggggcaattttagcaacccctgcaattgatacgatgaaacgggctaatggctcgcagattgctcatacggaagatcgttcaaccctatggcacgccttaacaccacagttctttccagcgaaatcgctcaaaaaggctttacaatcggcttttgagcaaggcttaaccatcactgacgaggcttctgcgatggaatttgcaggcttccacccgttattaattaatgggcgtagcgataaccttaaagtcactcgtcctgaagatttagctctcgcagaattttatctaacaagaggataataagatgattagaattggacacggttttgatgttcacgcttttggacaagatcgtccattaatgatttgcggcgttgccgttccctatcatacaggctttatcgcccacagtgacggtgatgttgctctacacgctttaaccgatgctctgcttggcgcagctgctcttggggatattggtaagctctttcctgacacggatatgcaatacaaaaatgctgacagccgtaaattattgattgaagcctaccgccaagttcaagcaacgggttatgtggtagggaatgttgatgtgacaattatcgctcaagccccgaaaatgcgaccttatattgaccaaatgcgtcaagtgatcgccgacgatctcaactgcgatatttcttgcgtcaatgtcaaagccacaaccacagaaaaattaggctttaccggacgtggcgaaggcattgcttgtgaagcggtggcgttattaattaaaccagcattatgcagtagttacagaaatatttaatttctttcgtagcatcagtgttcaaaccatatttcataaagagagtatagtaatgctattcaaaatacctttgttacaaaaggctgctaataacattgaaaaattaaggtagagtttgctcaacaatttttttcttttaatttgctttccattggttgatacaaaattgtggtaaactatcgccattttttagttacttaaaaatactatgccaactgtcaatcaatcctctcttgtgccttatagtgctgaacagatgtatcgtctagtcaatgactatgaaaaatatccgcagtttttatcaggctgtgttgaggcaacgaccttaagtttaggcgacaatgaactcaatgcagagttagtcattcaaaaattggggattagccaacgttttagcactcataacacgatgattccaaatgaaaaaattacaatggagttattaaatggaccgttcaaatatttaaagggtgcttggacgtttcagccctttgatgaacagagttgcaaaatcagcctaaatttggaatttgaattttcaagcccgatgattggtatggtgtttggcaaaattttcaatgaattaacgctcaaaatggtgaatgcgtttaaacagcgagcaaaagaggtgtatggtgtctgatacgcaaaaaattgtggtggaagtgatttacgcttatcctgaaaaatatttttataagaaaatggaattagacaatccactttccattcaaaatgtgattttgcaatcgggcgtattgcaaaaacatacggaaattgacttacgagaaaataaagtgggtgtttttagtcgtcctgcgaaattaacagatatggtggaaaatggcgatcgcattgagatctaccgcccgttaatcgccgatcctaaagagattagacgtaaacgagcggaagagcagaagaagtaacctataagggttatttcacaattttgaatttttgtgttgggaatattgtatcattaatttgtagatctaatgtatagtcgccaattggatccgtgttatcaaatttccaacaacgacgaatgaattcgttatttacacttttcatttggcttgtaatagtatgcatttttccatcttttgttgatactacattatcgccttgcccccccatcattgtagattttgctgggctattaaatatttcagtcgttttattttgagcagtaaaaggtacattgattacttcccagcataattgaatttttttattactgatagagtatgttgtgctatttagtgacttggggacttccccactaaagtcaattgtagtgagcaccatcatagggggctctggggcaatctttactgttgcagcaaatcccattgtagatggtagaagcagactagttatagtaataagatattttttcatctatttttcctctgatttttgatgggtatcacgcagttgttgagcgacaatcgcaattgcttcgccgctgctgataccttgttgcataagttgttgaatttgttgaacggcttgttgttgctgttcgtgagttaaactcagtagtgtattatccatatagaaccatgataagtctaataaaatttagtaaagttccaaccaaattgcgtaaaaagtgctttccactgttcgtcaagcggtgcttttatctcaattgtttgcaaggttttcgggtgaataaattgcaaactattggaatggagcataagtctatcacagcctgtgtttgctgttaatactcggttttgatgcaggtctccgtaattggtgtcgcccataattgggtggaacagatgttttaagtgacgacgaagctgatgtttcctgcctgttttggggtagagttgtaccagactataacgtgcggttgcaaattttcctgcagggtagggcatttcaacggtagcaatgtttcgataatcggtaatcgcttcttgtgcctctttttcttgggaaaatttatccgcaattttgtcgagttgcactttaagaggataatcaatccgcccttccccttgtagataacctcgaacaacggctaaatagcttttttgtatttgatgttgtttaaaaagctggcttatcgtccgtgccatttcgctatttaaagcaaaaagaagcacgccagaagtcggtcgatctaaacgatggatcggaaaaacgtgtagcccgatttgatctcgtaaagtttgcattgcaaaaactgtttcgtgtttatcaagccaacttcgatgaaccaacattcctgcaggtttgtttatcgcaataagttcatcatcttgatagataatctctagtttcattcgcttttcaacaaggtttcaagtttaacaaggggagcgtttaaggcttggagataatctaaatctttcaaggcttcttctagataaggcgaaatagcaaaattgcgaggcaattcggcattggcttctaatagggcgtgcattcttggtaagaagatccattgtaaccattgggttgcagagagtgtgctaacacaaaaaggttcatcattggctaaggcttctgcggaaggcggagttgcttcccagagattatgtactcgcaaagcaatttcgagatcggttaggtgttgttttacttgggttttcattgttattttatatgattaagaattcattgattatgttctatctacactattgtgtatcgagatatttttccctgctgttgacttaacagctgctctgccccgtctttatctagatctgccaagatcatcataatcgccaatttcgcattattctcagctaagactaacgtggtttctgcaatttcacgggagcattcagtcgcttgcataacaatccgaatagcacgggcgacaagtttttgattgcttgcctgcacatcaaccatcaagttttgatagcatttgccgattaagatcatacttgccgtagtaagcatatttaacactaatttttgtgctgttcctgatttcattcggctcgaccctgtcaacacttctgccccaacgacggtatcaattacaatgtcggcaatttggctcattgcagaattagggttgctggcaatcgacactgtggttgcgccaagctgtttagcgtatgctaacgcgcctaacacataaggcgttctgccactggcggcaatgccaactaatacatcttttgggctaaattcgaccgcttgcagatcttgtttacccgcttctttgttatcttccgccccttcgattgggtgtcgcaaggcacgctcgcccccagcaataatgcctttgaccatttcaggtgacaccccaaacgttggcggacattcggacgcatctagcacgccaagtcgtccgcttgtgccagcgccgatatagactagccgcccgccctgctgaaaggcttcgacaattttctcaacggcttgagcaatatgaggcaatactttttcgatcgccaatggtacttgtttatcttcgttgttgatgatttgtacaatttcataggcagaaagtgtatcaatctgcatactgtttggattacgctgttcggtaattaattgccctaaggtttttagaagatcttgttctgccatttttgttccttttatatattgggaaaaattgcccctaaactgaccgcttgtgtcgcccctgtgacgctaggcaaattcgcaggcagattgtgtatcctttgatacgcaagccacgcaaatgctgccgcttccacataatcgacatctaagccgtattccgttgtagtggagacctgccaatcggttaaatgggtttgtaaccgttccattatcaatggatttttcgctccgccgccgcataccaataaaacacagggataagcctgcggattttcaatttgccgtaaggcttgcactatgctttgtacggtaaattcaaccagcgttgcctgtacatcttcagcaggaagcggtttaatttgggttaatttatgttccaaccattccaagttaaacagctctcgccctgtgcttttcggcggtgacagttggaaaaagggttcgtctaacagcaatgcaagtaaagcggaatgaattttccctgtccttgcccattcgccgttcgcatcataccgcttgccgagatgtttttcgatccaaatatctaataaggtattgcccgccccgacatcatagccgatagtctgctggttaggattaagcacggaaatattgctgatcccgccgatatttagcacaacggttaggcgttcaggggaactaaacaccgcttgatgaaaggcaggaaccagcggcgcaccttgtccgccaaaagccatatcccgacggcgaaaatcacctacagtagttatacctgttctagccgccaataaattcatatcgccaatttgcattgaaaaaggatattgcccttttggtgaatgccaaacggtttgcccgtgacagcccaccgccacaatatcatcagcattgagttgatgtttagctaaaaaacgctgaatactgtcagcatagagcaaggctaattggtgatcgagttcgcctaatgcttgtaggcttgtttccccttttttgactaactgcgacagggcaacacgaagtgtgtcgggcattggggtgaagtcggcagcaattaatttgggcgtttggctaaaatcgactaacgccaaatcaacgccatcaaggctcgtgccagacattacgccgaggtaattttgagaaaccataggtaattataaaaataaaatactgctttcagctcaataatagaggataaaaattcatgtatttatgtttgagttctgattagccaatagacgttaggcacgattattaaattgctatgagataatactatgttgttttgctctaatttccgtatcactgtgcagtggcgttatctagagcaatattgctcactaagcctttattatcaaagtaaacaaagatagttctttggataggagcttcatagcctttacgcaaaatgaacacataatcccaacgatcttgagcaaaggaatctcgtagcataggtgttccaagcagatattgaacctgctctttattcataccaacttgcagttgatcgattttttcttgctctaaatagttgccttgcggcacatcaatacgataaacgactttttttatcgtagagcaagcagtaacacctaaggcaagtaataatacagcaacaagcgatttcattttcatagcgataaccttcctcttaaaatttttggcgattataccgaaatcgccgataaaatgtcattatttattacgttctaattgatctcgtaaatttgcaggcaatcctttgattgtcaaagtatcatttagttcatcccaaataatacgttgggacaataattcagcgtcaaagctgattgtcaccccttttcctgaacctgagtatttggttaaagtttttaacgcattacgcacaggcggaatactttcttctaaaccgtactcttgttgctcagcaaagtcagcaaaatcaatctcttttaaagttggcattgaagccgataattcgctgattgcaatttcttccccactattgatttgccctttacagtactcaaacacctgttttttaaccgcttgagtttggttactatctaactcgccttgttcacaataatcactcaccgcttgaagcaacgtttgattttgcacttgcggatttaacccttcttcagcccctaaaaagtccataaagaagtcggcaactttacgcccaacacgccctttaataaaggtcaaatagcggttagattgtgcattgtgttttagttcagtaaggttgatacggcaagcaatatcatattgtgtaatatcgagatattccgtgcgtttcacttccagtttatcatcaaccaacatagacgcacggctatcaattaatgcaataaagagatattccgtcgctaaaaaggtataacggcaaaggataaaagttccgcctgaagcaaaaggatatttgactaattctgtcgctaacattttggcacaactgtggctaaaaggcagaaattcgctttcgccttctaacaagcggtttaattgttgtgcaaaaatggattccgattgaaatatgccataggctttcgctttattttgataggcttgatgtagttgcaacatcatctgttcaacttcagggctgatcgcaagcagatcttcgcgtaaaaccgtatgaagctcagcagtttcccctgcggtttgttgaagttggtgtaaaacaatttcggtaacgttaatgctcataaattattctcgattataggtaaaaagttaaagtcctttgattgtatcaaagagtagaattaaggttaatggcatattttccaatggaatagcaccataagattgataccaacgagaaatgtcttcatcttttgcttcaatgagaagcccaattcccccgacttgttcggcaacgatggcacagcgtttgaaagctttaactaacagcattccgccaatgccttgtttttgatagcgaatatccactgcaagtcttgctaatgtaaagagcggaatagggtagtagccaaaacgttttttgcatagttcgggtaagtgttgctggtctaatgcacttaaggtgattgtataaaatccgataatctgttgactgtctaagtgtcggctaatgtaagtttttgatgtccctttttcgtgagattgccgagcgtattgtttaaaaaatcggttcatctctagatttccgcaatcaaaggcttcacgttgatgatgcttcgttaaaggctcttcaataaacttactcttcatgatagctttcctttgctaatttcgccgcttgttgtagttttgtattagctttcggcggattatcaagcaattccataatcaacgagagatcttgcggtgaaaattgccgattatcatactgctgaataatttctctggcactaggcaaaatacgttgtaatacaaattccgtaatattcgtatgggtaagtgcaacggctctaattaaagtctgcttgtcttccgtactaatgcgaatagacattctatcgttaagggcatttgcaatttgtggcataataaatatcctatttgtacagattaaagtagtacgaattttaagtgaaacagtagtaatcttcaataaaaatcacctttacaaaccacaaaaaaactttcaaactcgcaatgttgaatttaatttatttcactaggagatttttatgacaacagttattcataccgaaaatgccccaaaagcaatcgggccttatgtacaagcggttgatttaggcaatttagtgctaacatcagggcaaattccggttaatccacaaacaggcgaagtccctacagagatcaaagctcaagctcgtcaatcccttgaaaatgtgaaagcaatcattgaacaagcgggtttatctgtggcagatattgtaaaaaccaccgtatttgtgaaagatctcaatgattttgctacggtaaatgccgaatatgaagcatttttccgtgaaaaccatcacccaaatttccctgctcgttcttgtgtcgaagttgcacgtttaccaaaagatgttggcattgagattgaagcgattgccgtgagaaaataagcgatgaaaaaaattctaccaacttggtctgttcctgatttcgttcacgcattcaccactactcgagaaggtggggtaagccaagctccctttgatagcttgaatttgggtgatcacgttactgatgatccacaatcagtgcaaactaaccgtgaaatcttgcaagaacaagggaatttgccacattttccgctctatttaacgcaaacccatagcacaagggtgctacgtctgccctatgaacaaaacgacattgaagcagacgcagtttataccaatcaagcaaaccaagtctgtttagtgatgacagcggattgtttaccagtgcttttttgcagtaaagatggcaaagagattgcggcggctcacgcaggttggcgtggcttatgcgatggtgtgcttgaagccacagtggcagaatttgaatgtgagccagagaatatttgtgtctggcttggtcctgcaatcggcccaacggcatttcaagttggtgaagatgtaatagaacaattctgtgcctttgatccacaagcgagagaagcctttgtggcatatgaatatataagcggtaagttcctaggtaatctttaccagattgctcgccaacgcttaaataaacttggaattacggaaattgcagggggggattattgtacctattgcgatgcagaacaatttttctcttaccgtagagacaaagtcacaggacgaatggcaacgctgatttggcgtagtgaataattaagacttaaacagtatatatcttttcttttttacaaattggttcagaggtgttccgcctagatgaaatggtggtacattacttaaaatatatggtggattttatctctctattttatcgtaatatattgatttagttggtaggggacttccacataattctcctgtatttaaatgaaacaaacttatatttatttacaaaccgatcttctcattgtcggtggtggtatcgcagggcttgcgtgctgtgctgaagctaaggctcagggtattcaagcgacattaattaccaaagcccctatcggcagtggtgcaagtttttttccgttaaaagcaacacttggtattcaagtaaccggcgagcaacaggataaagcacattttcaagaagatattgagcgtgttgcacagggaatgaataacccgaaaattgtgcaagcctatattgaagattcgccacaggcgattgagctattagaacgtattggctttaaaccttggaaacggaatgacaatcgccccgcttgctttgcgaaatatccacgcccgatttatttgattaatcagtggcgagaagcagcggaaagagcaaggcagattatcaaagaacaggggacgacggtctatgaagatgcaacgctgttacatattgtcagcgataatcagcaagttcaaggagcgttgttttcctataaaacaagcggtgagatccgctatgtgctttgcaaaaccagtcaaattattttggcaacagggggaattgcagggttgtataaagataacctctatccagccgatgtgattggttcaacccacgccattgctgaacgagcaggggcaaggctgactaacttagaatttattcaatttatccctgcttttgttgaacctaaatacaaagtgctgtttggagagcataccttaaaatatgtcagtaaagtgactgacagccaagggcgagatctgtttccacacctttcaccacagcagtttcaacagatgatgaccgctcgcagtgattatgccccttttagcattgatttcccctgcgttgagtttgatttggtgatgatgaagcacttgctcgaacacccagaagaaaaaggcatctatctgcactattcccctgagctgtatcaagatcaaacggaattttacaccgtgtatttaagctggttagagaaagaagtcgggattaaccttgtacgagatagagtggcgattaccccatttgctcacagttgtaatggtggtattgtaattgatgaatttgccgaaagtgaggtgaaagggctttttgcggtgggcgaagtttcttcttgtattgaaggggcgaaccgtttaggtggcaattctgtcggaggtagtttggtttttgctaaacgagcaatccaacggattttgcaaaatttagcggaaaaccgaccgctttccaacgatatagcgtgtgaacgtaacattgagcagtttttccagtcgttagcaaatccaaagggtgataaaatgctgacggcaagtgaggtgttaagcaccattcgctctcagatggcgacatatgctaatgtttatcgaacagaagcgaatttgcttcaattattgaactgcttgacgcagttagagcaacgttattgccctcttgaatatcaagcctatcaaggtattgaaatttaccacgctctcaaagccgcacaaagtgtggtaaaggcgatgctgagtaggaaagtgagtttaggggcccattatattgtttgatgtatgctattttttcaataagtgttgaaaaatggactacgcaaacgttttcttttttttgtagaatagtttccgttttgccgaaaggcaatattgaggtatttatggttgatgcgattattatcggaattatcgttttttctttattagtcagtgtatggcgaggctttgttagtgaagtctttgcgcttgtggggtggatagcagcttttttggtttctagccatttttatccttatttaagtaattacttattacaaatcaactctgtctatatccaaaattccgaatatttgcgtaatggtattgcgattgcgattttatttattgccgtactcatcatcagtgcggtgattaacgcactactcagccaacttgttgataaaacaggtttaagtggtacagaccgtgtacttggtgctggttttggtatattaagaggcatttttattgtcgcagcgatactctttttccttgatacctttacggcatttagccaaagcgaattatggaaggaatcacaacttattccacactttgatttcattgtgaagtggttctttgaacagttacaagcaaattccagttttttaaaatctagctaatttaagaggtaattatgtgcggcattgttgggattatcggtcaaacccctgtaaatcaggcgttatatgacggacttacgttattacaacatagggggcaagatgcggcagggattgtcactattgacgatgaaaaccgcttccgcctgcgtaaagcaaatggcttagtcagtgatgtgtttcgtcaagaacatatgttacgtttgcagggaaatgttggtataggacacgtccgttatccaactgcaggtagctcaagtgtatccgaagcacaaccgttttatgtaaattccccttatggtttaaccctagtacataacggcaatctcaccaacaatgcagagttaaaacgcctactgttcaacctagccaaacgccacgttaatacaaactcagattcagaatctttactcaatatatttgcttactatctcgatcaatatccacacgaactcctaacgcctgaaaatatttttgaaagcgttcgcaaaactaaccaagtgattcgtggggcttatgcttgtttatcaatgattatcggacacggaatggtggcatttcgcgatccactcggtatccgaccgcttgtacttggcaaacgagaaattgacggcaaaacagaatatatgttcgcatcagaaagtgttgcacttgatgttgtaggctttgaatatgttcgagatatacaagcaggcgaagccatttatattacctttgatggacaattctactcagcaatttgtgccgataatccgaaattaaacccttgtatctttgaatatgtctatttcgcacgtccagattctgttattgatggcgtatctgtttacgcagcaagagtacatatggggaaattcttaggcgaaaaaattgcgaaagagtggacagatattctggcggatattgatgtggttatcccgattcctgaaacttctaccgatattgccttacaaattgcaacagtactgaaaaaaacttatcgccaagggtttgtgaaaaatcgctacgttgctcgaacctttattatgccagggcaggcacaacgaaaaaattcagtccgtcgcaagttgaatgccattgcctctgaatttaaaggaaaaaatgtattacttgttgatgattcaattgttcgtggcactacctcagagcagattgttgaaatggctcgacaagcgggggcaaataaagtctattttgcctcagctgcccctgaagtacgttatccaaatgtatatggtattgatatgccaacctgtgaagaactggttgcttataatcgtagcgtggaacaagttgctgaaatgattggtgtagatcgcctgattttccaagacttatcggcgctctttaagtctgttcagttagaaaatccagatattcacaactttgacgcttctgttttcactggggaatatataacaggcgatgtgagttgcgaatacctaaatgcgatagctcaagcgcgcaatgataaagccaaaaccgcccaagcgaagcaggcaggtaatttggaaattcataatgaataatcaagaatgaggcatagcagacaaaagtgttggttttaattatttcccctaattattaggcggcatagtagacaaaatgcctttagtatttgacgactaaaggcatttttcgtagggaagttaattatgattattcatctttatcgattcggctaaacaccgcactttgctgatttttatattttgcatctttacgagcattatatggatgttctgcgtaaccacttaaaatttcaaagctcaatgcaccaattgccatattaggacgtaatgcaagcggtaactttcccgcattaaaaaactcaagtacgattttgccttcccaacctggatcgatacgatgggcagtaacgtgtaccattaacccaagtcgagccaaagaagaacgaccatcaagccagccgactatgttggcaggtagtttcactgattcaagcgttgttgctaaagccagttccccagggtgtaggaaaaaggcttcatcatcggcaatcaggatttcatcactcattacacgattaagctgtgccgtcatttcttcacgtgggccgcttaaatcaatataaggcgttgaatgttcacgaaacacacggaaagaattacctaaacggacatcaatcgtcgctccactgattttttcatttgatgggcgaggcgttaggctgataatcccttcatcaagataacgttcaatatctttgtcacataaacgcataattccccctaatatattaactatgtcctaatagctgtttaatttgtgctttcaagatattaatcgcaatacggtttttaccaccttttggaataataatatccgcatactgtttagatggttcaacaaattgtaagaacatcgggcgaaccgttttacgatactgatttacgatagattccattgttctgccacgctcctccatatcacgctgtaaacgacggataaagcagatatctaaaggggcatcaacgaaaatagacacattaatttcatcacgaattttttcatcagtaagtaataaaataccttcaagaatgatgatttttttaggagtgaagtgggttacggtttttttgcgattatgttctgcataatcatattctggaatatcaacagtttgcccttgtttgaggcttttaagatgggtaactaacagttcgtgatccattgagtttgggtggtcgtaattggtttttacccgttcttccattgcaagatggctttgatctcggtaataagcgtcttcagaaataataccaatatcatcttgccccaattccgcttgcaattctttgtaaatagtcgaagcaataagacttttaccagaagctgaagcccctgcaattgcaataacaatacaagattcgttttgagtggtgtttgacataattaaatccttgagcacacaactggagaatttagggaattatatcgcaaaatccgtaatcttttgaagataattaccgaattttggagcctgtactaattttagtagtattcatgcttcatgtcagttcagtattcatttaaacaaatgtgtatagtaaacatgaattacatctaattaaatgtaggtttacaatcttcttgcttgccaaaaacttctagaccaataaggtgaattaagatctgaataaattacgccgccttttgtagatgcgtgaagaaactgcccatttttgacgtaaatgccaacatgtctgccatttggcccacgaccagttttaaaaaagacaagatcacccgtacgtaattcactctttgagatttgtatgcctgcttttgcttgatctactgttattcgaggtaaatcaataccaaataactctcggaaagtaagttgcacaaaaccagagcaatcaataccgctttttgttataccgcctagacggtagcgtgtaccttcccactctctttgatgttcgcttaaactgctaatcacaaaaatggagtctgaaagctgccctttatgtttatttccgcttttatcttgaaccgtagtgatttttgatacacaagcggacaacaaaaatgcacaaaacagcattgtgcataaagaaaaatgcttttttattaactgagaaaacattgcgatccttaaaaatattctgcgaaatacaggatttcgcagaataatcatttaggcttttaccttcgcattttcgacacgttcacgcaatttttgtcccgctttaaaaaccacaactcggcgagcagaaactgcaatatcttcgccagttttaggattacgacctggacgagcttttttatcacgaaccgtaaaattgccaaagcctgacagttttacctcttcaccgttttctaacgagcgacgaatttcttcaaaaaagtcctcaacaaattgttttgcgatacgtttatctaaaccacatctttcgacaaggttttctgcgatttcaattttggtaagtgccataatttatccttaaaatctaatctcttagataagcattaaaacgttgtgcaagtgtttcgagaacagcttgaaacaccgcattaatttcttcctcttcaagggttttttcagtgtcttgaattgttaagctgatcgccaaacttttcttaccttcaggtaaatttgtaccttggtaaacatcaaataaattcactgccacaagtttagcgccacctgcttgtcgagccacatcaagtagatcacctgcaggtaaattgctatccacaaccacggcaatatcacgtttatttgcagggaaatgtgaaatttcttttgcatttggtactgaacgctctgcaattgcagaccataataattcaaaggcaacaggtttacctgacaatccgagtttttgaacaactttagggtgaattgtgccgatatagccgatctcttgatcgtcgagtaaaatagcagcagattgtccagggtggaacgcaggatatgattttgcaacaaaacacaaacgattgctagcatttgttagtgataaaacacgttctaaatccccttttagatcaaagaaatcgacgttttctgctttatgttcccaatgtgctggacgtttatcccctacaatcactgcacctaatacaaattcttggcgtatgccattttctgcattggtatcaggaataaagcgtaaaccactttcaaaaatacgcactcgattttgctggcgattttggttataagcaacggtttcaagtaagcctgttaaaagcgacacacgcattgccgacatttcacttgaaattggatttggcagaattaacgcttcttggcttgggtgtagcagttcttgtacttttggatcaacgaagctataagtaatcacttcttgataatcgctatccaccaaagccgttctcacacgaatagcttctaaaagcttctctgggaaacctttcatctgtaaatgagcaagcggtgcgtgatttggaatgctgttatagccgtaaatacgagccacttcttccacaagatcttcttcgatctcaatatcaaaacgccagcttggtgattgaactgtccagctctcgtctgcatagcttgggtttaagcctaagcgagctaaaatatcagttacggcttctgtttcaatatgatgaccgagtaagctatctaatttactacgacgtaaaaccacttgttttgacgttggtaaatgggctgaacttaccgcttctacgatttcaccagcttcaccgccacaaatttcaagcagtaacgctgtcgctctttccattgctttacgcgttaattctggatcaacgccacgttcaaaacgatgagatgcgtctgtgtgtaagccatattgtcttgcacgacctgtaattgcaagcggtgcgaagaatgcagcttctaacaccacatctttggtttcggcatttacgccactcgcttcaccaccaaaaataccagccattgcaagcggtccgttttggtctgcaattagcaaagtatttggctgaagttttgctgtcgtgccatcaagcaatacgagttcttcaccctcttttgccatacgcacttgaattgcaccattgatttttgctgcatcaaaagcgtgcattggctgaccaagttccagtaagctcagattggtaatatccacaatcggatcgatagaacggataccacaacggcgtaatttttcttgcaaccataatggtgactgtgctttgacattcacatttttcaccacacgacctaaatagagtgggcaagcttcaggggcttgaagttcaatcgtcactttatctgcaatagttgcaggcacagcttgaatttcaggtgcattcaccgctaattgattaacaaccccaacttcacgcgcaattcctgcaatgcttaaacagtccgcacggttaggcgttaaactaatttcaatggctctgtcatttaatttgagatagtcacggaaatcaataccgactggagcatctgctggcaactcaataataccgctatgatcttctttaatccctaattctgagaatgagcaaagcattccctctgacggctgaccacgcaatttagttttcttaattttaaaatcacctggtaacaccgccccatctgttgcacaagccactttcaaaccttgacggcagtttggtgcgccacaaacgatatctaataaacgttcgccacccacattcactttggtgacacgcaatttatcggcatcagggtgctgagcgcactcaaccacttcgccgatcacaacaccgttaaattcacctgcaaccgcttcaacggcatcaacttctaaacctaacatagtaatttggtcacatagctgttcggtggtaatcgctggattaacccactcacgcaaccaactttcgctgaatttcattatttctatcctatatttgtaacgttttctacaaattttaccacttgttatgatagacacacgcagtgtgtccctacaagagaaaataagccattaatatagtagggacacactgcgtgtgtccgcaaactgcatatatccgcaaaatgattagattacttaaactgctttaagaaacgcagatcattttcaaagaatgaacgtaaatcggtcacgttataacgcaacatcgtcaaacgctcaacgcccattccaaccgcaaaaccagtgtattcatcaggatcaatgcccacattgcgaagtacattcgggtgaaccattccgcaacctaacacttcaagccatttaccgtttttacccattacgtccacctctgccgacggctctgtaaatgggaaataagacggacggaaacgcacttgcagatcttcttcaaagaaagctcttaagaaatcgtgcaataagccttttaactcagtaaagttcgcttttttatctacataaagcaattcaatttgatggaacatcggcgtatgagtttgatcgtagtcgttacgataaacgcgccctggcgccataatgcgaataggcggttgcattttttccatcgtacgaatttgaacgcctgatgtttgtgtacgcaacaaacgctctgcatcaaaccagaaagtatcgtgatctgcacgagcagggtgatgtgcagggatatttaacgcatcaaagttataataatccgtttcaatttcaggacctttctctacactaaagccaagttctgagaagaatttcaccacacgttcaattgtaatcgacacagggtgcaaaccacctaactctgttttacgaccaggtaagctcacatcaatactctcactggataatttagcattgagctcttctgtttctaactgctcttttttcccatttaacgcatcttgtgctttctgttttgcttcattaatttttgcacccaccgcaggacgttcatctgctggcacatcacgcaagccttgcattaacaaggtaaaatgacctttcttaccaaaatattcaacacgcaatgcttcaagacttgcaacatcactggctttttcaaccgcttgcaacgcttcagcaacgatattttctaggttttgcatacctaccctctaatcaatttcaacataaataaactgaatgcctcattcataggcaaaacgccttgaataataatacttctaagcgatattgtaaatttaaaagtgaggattttgtgggggtaacattttgatttgtaacagctatcaaagataaacactgtgattattttaccatttttgctaaaaaaacaccaaatatcaccgcttgttaaacattaatccgtgatcttcttgaaaacatacggtaaaatttacaccgatttgcaaaagtgcaaatcaacgctgttaaattttattggagatatacctatggcaaagaataatattttaggattattcgcacagtcgccactcaagccattacaaaagcactcaaaaaaagtgactgaatgttgtggattactaatcccattttttgaagcgagttttcaaaaaaattgggaagtagcggaagatatccgtcgtcaagtcattgatttagaaaaccgcgcagatacccttaaacgtgaaattcgtttaaaatcaccgcgtggtttatttatgcctgttgaacgtactgacttacttgaactcgttacacagttagataaattagcaaactatgctaaagatatttctggtcgtgcaatcggtcgtcaattaaacattcctgaagaaatccaacctattttccaacaattcttaacccgtagccttgatgcaacagttcacgttgataaagtaattaatgaaatggatcacctacttgaaacaggcttccgtggtcgcgaattaaattttgtgaacaatatgattttagagttagatgttatcgaagacgatacggatcaacttcaaatcgtactacgccgagcaatgttagcgattgaacaacaatacaatccaattgacattatgttcttatacaaaattatcgaatgggtcggagttcttgcagatcaagcacaacgtatcggttcacgcattgagttaatgttagctcgttcataatcgaaagaggacttaaataatggaactgattcaagaatatggctcgatgattatcctcatcaccgcagtgtttggcttctttatggcatttggtatcggtgcaaacgatgtttcaaatgcaatgggaacctctgtaggttcaggcactatcactgcaaaacaggcaattttagttgcaatggtttttgaatttgctggtgcttatttagcaggcggtgaagtaactgaaaccatcaaaagtggcatcattgatattcaccaattctctggcagaccagacacccttgtactaggtatgatgtcggcactttttgctgcaggtacttggttattacttgcctctaaaatgggctggccagtatccactactcactctattatcggtgcaattatcggttttgcgttagtcaccgttggtgcggaagcggttcattggggtgatttgtctggtatcgtaggtagctggtttgttacacctgttgtatcggggatcattgcttatgctatttttactagcacacaaaaactgatttttgatactgataatccgatgaaaaatgctcaaaaatatggtccattctatatgggtttaaccacattcattttgagtattgttacaatgacaaaaggcttaaaacacgttggtttacagcttacaatgactgaaaccttagtgatttcaagtgcaatctcaattacctctatcatcacttgtttcttctacttccgtagccaatcttttgctaaccgtgtacaaggcggtgcatttggtggtgtagaaaaagtgttcagcattttaatgttactcaccgcttgttcaatggcatttgctcacggttcaaacgacgtagctaatgcgattgggcctttatctgccgtagtatctatcgttgagaacggcggtgtgattgaagcgaaatcaactctcgccccttggattttaccattaggtgcaacgggtatcgttgttggtttagcggtaatgggctacaaagtaatgggaacgattggaactggtattactgacctaaccccaagccgtggtttctcagcagaatttgcaacagcaatgaccgttgttgttgcctctggtacaggtttacctatttcaacaacacaaaccttagtaggtgcggtattaggcgtaggttttgctcgtggtattgcagcgttaaacttaacagttattcgtaatatcgttgcatcttgggttgtaaccttacctgctggtgcattcttctcaattttaattttctatattttgaatgcaattttctattaatttagaatagtgactttattcagaaaagtgcggctattcgcacttttcttttatgattttttaaggattgtttatgcaaaaacatatttctcttttctgctcaactctgcttttagcaatatcacttccctcttttgctcaaacacagtacgttactgaaaatttgaatacctatttgcgtaaaggtccaggcgatcaatttaagatttttggttcaattcaagccggtgaaaaagttaccttaatcgaaaccaaagatcgttattctctcattcgtgatagtaaaaaccgtgaagcgtggattttaaattctgaattaacatctacgccaagctcaaaagaattaacaccgttattacaacaacaagttcaagaattaaccaccaaactcaataatattgatagagattggcaacaacgtaccgctgaaatgcaacgtagagttcaacaatctgcattacaaagtagtgaattacttgaacaaaatgcacttctaaagcgagaattagaaattattaaaaataaaaatcgtgatttagaagcaatacaagatgtcgcatctcgcgaaattatgattcaatattttatctacggaggagctgttctaggcttaggtttaatatttggattacttatttcagcccttcttcctcgccgtaaatctaattatcgctggaattaactcaaaacaaccgtacttttagcttactgtgatgtttttaatttggggtatagtagacaaaagtgttggttttaattatttcccctaattatcaccaactctttttatttgaaaatcctttataaacataatcttatgctttttcgttatccattatgaaccgataatttctgcttcagttctttaaataagccttccagcctatttgttgttttttctatatttaaatgagcatattcttcaaaagtaaataaatatttcatatagtattttaaactggcataagcccctcttacattacggtgtttataaggaaaatagcctttctcattgggatatttagatcgttcatttaaaaactctttatgttttaaataccattgatgtaatcttaaataaaattcgtttttgtggctttcttttagcgtttttacaataatctttaattctttacccgcttgtgattgatgtctttttcttaattttctcatcacaatggcgaccatatgaaagtggcacatttgaattgggggattgaataaatcttttaacagccctctacgcctatcatttgtaatggattgaattctatagcctttttcttgaagtatgttcaatgcgagtttgtaatagaagtctttttctgttttgatgacacggtgataaacgactttttataggtttgttttcctattgtgtaatcagtccaaatatctattggatttaatttctttgtgaaagaaaaagttttatgacaggacgaacaaaagtatctctattatttttctttccatacttttggatattgttcttgaggcaaaaaggacagttttttgttgatatttcaaaaagtaggcttaaagccttgtactataaggctttaagccacttttgaccaacacttttgtctactatgcttttgaacatcaggacttacgagcgaggataaacctcgcccctacataaattttcctaaaattgacttttatgcaactgctgcattataccgattaaatctccgtcttctctttatactcacacaaatcttcaataatacaagagccacagcgaggcttgcgagcaatgcaggtgtagcgaccgtgtaaaatcaaccaatgatgaacatcaaccttaaattcatcaggcacgactttcaacaatttttcttccaccttaaccacatctttccctggggcaaaattagtacggttagaaacacggaatatatgcgtatcaacggcaatagtcggctgaccgaatgcggtatttagcaccacatttgccgttttacgtcctacacctgcaagggcttctaattcttcacgggtttgaggtacttcgccattatgtttttcaattaaatcacggcaagttttaataatgttttccgccttgctgttataaagcccaatggttttaatatactcttttagcccatcaagccctaaatctaaaatcgcttggggcgtatttgccacaggataaagttttgccgtggctttattgacccccacatccgttgcttgagcagataaaatcaccgcaatcaataattcaaaagggttggaataattgagttctgtggttgggtgagggttctcattgcgtaaacgggttaaaatttcaatacgtttttctttgttcattcattatcctataaaagcaaaatagctctgatcccacaacatttttaccaccataataaacgacatcataacaatcaacgggcgaataatctgttttcctttggtgacaaccattctcgcccccaatgaagccccgataaattgtccaatcatcattagaaaaccgattttccataaaatcgcaccgccaatgatgaagaaaatcagcgaagcaaggttagaggtaaaatttaacactttggagtgagtaacgctttgggtcaggttaaaaccaagtaataacacaaaagcgagcgtaaagaaagagcctgtggcaggcccgaatagcccatcataaaagcctattcccattgccgccgtgcaagcgaacatcggaaagctcattctttggcgacgttgttcatcgcctaggcttggactaaagagaaaataacagccaataattaagatcagaaaggggagggcaacttttaatgcattgacatctatcatctgcactaaaatagtcccgattgaaccgccgataaaggtcagcaaaataagcaaccaaatctgcttcaaatcgaccgcttttttacgcacaaaatagagcgaagcggaaaacgagccgccacaagcctgtaatttattcgtgcctaacgcaaccgcagggggaaaaccgaccgctaataacgctggaatagtaatcaaaccaccaccgccagcaatggcatcaataaaaccagccacgaaagccgcaacaaataagataatcgcaacatcaagtccaagttccatatttccccctacgatctattaattaataatgcaccaccatttcatctcggtggaatactactgaaccaaactcatagcccaaaatggtttcaatctcgctagattttttgcctttgattaatgctagagcatcactgttataacgactaatgccaagggcaagcactttgccgttaaggttacaaatttttgccacttcaccacgcgcaaattgcccttcgattttggcaataccagtaggtaagagcgatttatgctgttctactaatgcgttttctgccccttgatcgatataaattgtgccagcaggcggcgcaccaaagagccactgtttgcgtccttcgattttgtcgtgttgagctaagaagcgtgtgccaatttccgttccttgtgccacttcaaaaatcacattaggacgttcgccagaagcaatcgctgtttcaacgccagaacgggtggcaatatcggcagcggtgattttggtactcataccgcctgtgcctaaggttgtaccacttccccctgccatttggcgaatttcaggggtgattttttcaactacaggaatgcgttttgcatttggatttgaacgtggatcgctgtcgtataacccttcttgatcggtgagcaaaatcaataactctgcttgagctaaaatcgccaccagtgccgataaattatcgttatcgccgatacgaaactcagccgttgccaccgcatcattttcattgataatcgggataatttgttgatcgagcaaggcggtgagcgtatcccttgcgtttaaaaagtggtctttattttcaatatctgcacgggttaaaagcatttgcccgattttgatgttataaatggaaaagaggctttcccacacttgaataagctggctttgtccgacggcggctagaagctgttttgtcgccaaggtttttggtaattcacgatgccctaagtagtcacgcccagcggcaactgccccagaggtaaccaaaataacacggtagccttgttcatgtaattgtgcgatctgcttaacgatttctagcatatgtggacggcttaagctttttgtgccgtgggttagggtgctagtgcctaattttactacgattgtttttgccataataatttgtaaaaagaaaagaaacttttgctattatctgctaaaatcattttcatttcaaaagagttatgttgttatgattcaaattagtgtaattgttacccgcactttgaataaagtgattggtaaagataatgcaatgccttggcatttacctgttgatctcgcatggtttagatcaaatactgtcggtaaaccagtcattatgggccgaaaaacctatgaatctatcggcagactgttgccgaaacgtccaaatattatcctttctcgcacaggcttcagtgtagaaggagcttattctgcgacaagccttgaacaagcggtggaattagccaaaaattttgctaatagcgatgaaataatgattatcggcggcggtgagttatacaaacaagcaatgccttttgccgataaactttatcttactgaaattcaagccaatatagagggcgatactttttttgagtttgatgaaacagagtggcaacaggttgcagagaagtggtctgaagtagatgagcaaaatagttaccgttgtcggtttatgattttggataagttaaaaaatgattgataagtgattaaaaaataatcactcttagttgttgtaaaataattgtgattttattttgagcaaacgatgaggatttatgtgattaatttcacaatttaataacattttgcttttttgtttacaaattttcactagaatacgagcctcaatatggacctttatggtgttttcttttttgaggtattttatggctctgtttctcagtatttttcctatcgttttactgatttatttaatggtaaaacgcaacgcattaccttcctatgtcgctttaccgtggattgcggtagtggtgttaattatccagctaatctatttcggcaccgatattcaaacggtcagtgcgaatattgcttctgccttgattgcggtacaaacaccgattaccgtcattttcggtgcagtgcttttcaaccgtttttcagaagtatctggtgcaaccgatgtgttgcgtaaatggttatcgaatatcaacccaaatcctgtggctcagttaatgatcatcggttgggcatttgcctttatgattgaaggggcgagtggtttcggtacacctgcggcgattgcagcaccgattttagtcggtatcggtttccatccgcttaaagtggcaatgttggcattagtaatgaactccgtaccggtttcatttggtgcggtgggtacgccgacttggtttggtatgggagcgttacaattaggtgaagagcaaattttagaaatcggttctatcactgcatttattcactctattgccgcatttatcattccagtaatggcattgcgtttaatcgtgagctggtctgaaattcgtaaaaatatcgtgtttatctacatcagtatttttgcttgtgtgatcccttatttcctaattgctcaattaaactacgagttcccgtcattagtgggcggtgcaatcggtatggtgatctctgttttagtggcaaacaaaggtatcggtttagcgaaagtggataataccgttgatagcaatgccgtaaccactgcacaagtagtgaaagctttattcccaacaggtttattaattgcgatcttaattgtaactcgtattaaacagttaccattaaaagcaatgatgaacgatgcaacttcttggttcagcgtaaaattaggttcgcttggtgtatttgatattagccacgggttaattttcagcttaaaagaaattttcggcacaacaattagctcaaactacaaattgctttatgtgccagcattaatcccgtttgtgattaccgtattaattgcaatccctatatttgctgtatcagcgaaaaataccaaagagatcttcgcaacaagcttaaaacaaacgaaaaacccattctttgcgcttgtgggtgcgttaataatggtaaacttaatgcttgtaggcggtgatggttcaatggtgaaaatcatcggtcaaagtttcgcacaagcaacaggggaatactggactatcttcgcctcttatttaggtgctgtgggggcgttcttctcaggttcaaataccgtatcgaacttaacctttggtagcgtacagctttcaacagcaatggaaacaggattatctgtgagcctaattcttgctgcacaatctgtgggcggtgcgatgggtaatatggtgtgtatcaacaacatcgtagcagtatgttcggtattgaacatcaataataaagaaggtgaaattatcaagcatacggttatgccaatgtttgtttacggtgtaattaccgcactttcagcactctttattgtgccgttgttctacaatgtataattatcggtaagttaaatttatgaagaaacaagcggtgtgttttagccaataaaatccaaccgcttgtttttagcttttttactatttttatttgttggagtttttatgaacgtgaatttttacgtcacctgtattgccgatatcgtcaaagcaggcgttgccaaaaatagcgtgctattgttagaaaaactgggttgtaaaatcactttccttgaaaaacaaggatgttgtggacagcctgcaattaacagtggttatacaaaacaagcccttgaggggatgaaaaagttagtggaaacttttgaagtcaatgattatccaattgttgcccctgcaggttcttgtgtttatgcaattaaaacctatcctgaccattttgaacgctttggcgaaccagaatgggcggctcgtgcgaaaaaagtcgctgaccgttttcacgatttaacagattttatcgtcaataaactgggggtcaccaatgttggcgcaaccttaacaggcaaagctgtttatcacccatcttgcagcctatcgcgtaaattaggtattgtgaatgaaccaatcaccttattacaaaacgtcaaaggcttagagctgttaccaattcaaaatcaacaaacctgttgcggtttcggtggaactttctcggtcaaaatggcggaaatttcaggcgaaatggttaaagaaaaagtagagcatattactgatgttgagcctgagtatttgatcggggcagatgtgagctgtttaatgaacatcggcggacgtttaagccgtgaagggaaaaatattaaggtaatgcacattgccgaagtattaatgcaggagggcaaataagatgtcattaaaaactagcaatattgcctttaaaaaacgagtggacgatcaaatccataacgcaatgatgcgtaaagcggtagtgaaagcccaagaaactatcggggcgaaccgtcaaagaatggtggacgaacttggtcactgggaagagtggcgtgatgcggcaaaacagatccgtaaccacgttcttgccaatttagatgcatatctctaccaattaagcgaaaaagtgcaacaaaacggcggtaaagtcttttttgcagaaactgccgaagaagcgaccgcttatatccgtcaaatcgccttagaaaaaaatgctaagaagattgttaaatccaaatcaatggtgacggaagagatcggattaaacaatgtccttgaaaacgaaggcattaaagtggttgaaacggacttaggcgaatatttactgcaaatcgttggcgataagccatctcacatcgttgtacctgcaattcacaaagatcgctataaaatccgtcaagagttacacgaacaactcggctataacggctcagaaacgccagaagaaatgaccgcctttgtgcgtcaagtgatccgcaaagatttcttagaggcagacatcggtattagtggctgtaactttgccgtagcagaaacaggttctgtctgtttagtgaccaacgaaggtaacttgcgtttagcgacaacggtgccaaaaactcatatcgctgtaatgggtatggagcgtctagccccaactttccaagaagttgatgtgttaatcacaatgctagcaagaagtgcggttggtgcaaaactcactgcctataacacttggctaacaggaccacgtcttgaaggcgaaacggacgggccagaagagttccacttagttatcgtggataacggacgttcaaaaatccttgaaagcgaatttaaagaagttttacgttgtatccgttgcggtgcgtgtttgaacacttgccctgcgtatcgtcaaatcggcggacacggctacggctctatctatccaggaccaatcggatcggtgatctcgccattactcggtggctatgaagaatttaaagaattgccttatgcttgttcgctttgtaccgcttgtaactccgtttgtccagtgaaaattccactggcacaactgatcttaaaacaccgtgaacatatcgctcaaaatggtatgactccagcagcagagcgtttatcgattttcggtttcaactttgctaactcgcacccaactttatggaaagtcggggtgaatatcggggcaaaagtggtaggtaaattcatcaaaaacggcaaagcaccaattcaagtaggcgcacttgcagaatggacaaaagcccgtgatttaccgtcagctgaaggcgaaagtttccgtgaatggttcaacaatagaggataagagaatggatttacaaaaccgtgaaaattttctaaataaactggcggaaagaatgggcagaccacgtcagctcgtgcctgaaccaatgccgaaattagtcaatgattatccaacgacacgcttaacggatcgcactcaagctcaattagtcgaggaatttgttagctttgctaaagtgatgatgaccgatgtagcggtggtgaaagaagaaaatctgatcgcagaagtgaccgcactttgtgataaatatggcggtggctcggtgattattaataacgacagccgtttagttgatttaggcattacgccagcactacaagctaaatacgacagctatgtttgggatcacaatgcagatggcagtgtgaatatcgacaaagcggaaaaagccaatatcggcgtggtttacggcgaatacggcttaacggaatctggcggtattgtactgttttcagataaagaatttggacgctcagtcagcctgttacctgaaaaatccattgtcgtcttgcgtgccagcaccgtgttaccccgtgtggcacagttagctaaaatcctacacgacaaagcccaacaaggcgaaagaatgccatcttgtgtaaacattatttcagggccaagcgctacggcagatattgagttaatcaaagttgtcggcgtacacggacctgtgaataaggtttatgtggtcattgatgatctataaataaattgttactgcgaatggaatggttcaatcaaatgtgattgagccattttttattctagataaagcgtgataaaatccgcatcatttctatcttgaattatctataaaatggctaaacaaaatctcttaacggcacaaggtgagcgagtggcgattgttgctggattacgcacaccttttgttcatcgtgatacaggatttaaatcttcttatgcaacagatttaggcacaatggtaacaaacgagctacttagtcgtgctgccgttggtcatcaacatattgaacagcttgttttcgggcaagttattcaacagcctgatattcctaacccttctcgtgaaattgcgttggcgttaaatatgccttatgtgcaggcttatactttgagtagctcttgtttatctgggttacaggcgttggtaaatgtggctggaagtattattagcggttcgatttctgcagggattgcagggggggcggattctatttctaatgcgccttttagtatcagccctcgtgttattcacaagctcaaggcgatttttaatgcgccaaccttagatgataagtatcgtttgttccgtgaattttcgtggaaagagcttaaacctcacggggttaatctcaaagattatatgacccaaatgtctgtggcggaaatttctgagcagatggcacagcaattccacattagccgtgaagctcaggacgaatatgcgttaaattctcacattaaagcacaaaatgcgtggaaattagggttgttaaaagatgaagtgatgccttcattccctcgtccttatgctgattttgtggtgtctgatagtttgatttcttcggcctctaaagcggcttactatgaaaaattttcgccgttaatgaataagagctatgcaacagtcacagaagcaaatatgccacgacctgtagatggagcggctgcggtgctactgatgagagagcaaaaagcgaaagaattaggcttagacccattaggttatattcgtagctacgccattacaggcaatgatatttggcaaaatatgtttatgggggcaacggtggcaagccatcttgcccttgagcgtgcaaaggtgaccttgtctgatttggattttattgatattcacgaaacctctgccagccagatgctggtgaatatgaagctgtttgcttcagatgattttgctaaaaaacagcttaatcgttccgcttgtattggggaaattgatcctgagaagttgaaccatttgggcggttctattgcttttggtaatcctcgtgcggcgaccagtttacgcattttaattcaatcgttgaaagcgttgaaacgtaagggaggcggattgtcgttgattgcctcaagtggattaggtggattaggttctgcaatgattttggaaagcgagtaacagtatgacaacacaagcacaatatatctcaccttttcacgttgagattgatgataatcgaattgccattgttcgtattgatgtaaaaggtaaatcgcaaaactggttgcctgagccgtttatcgaagatttacgcgatgtgatgggttctgtgatttatcaacaggctcgaggcgtgatttttgtttcgggtaaaacgaaaggttttattcaggggtatgatcctgattatttgcgtggtaaaaatgatgagcagttgaaaaccttatctcataatgctcagttagtaatgcgtgaaattaatacgctcaaaatgcctgtggttgcagtgattgatggtggctgttatggcgtggggctagagctggcgttggcgtgtgattatcgtattgccagcgaggaaagttataccaaatttgcaatgccacaaattcgttcggggattttgccttttgctgggggaacacagcgtttgcctcgtttagtcggcttgcaaaatgcagtcacaatgcttttatctgggcagaaaattggggtggaaaaagcgttaaaaattggtttggtggataaacttattcctgctagcaatctatttgaaacggcatatcagttgttgcttaatcataaagtgcaaaaaattgaccataaaaatccgcttgataatgttaaaaaatggcgtaaacagcttgagggcaataagtttatccgtgaaaaatatttggctcatattgaaaatcgagtgtgggataaggcttttggcaactatcctgcagttgaggaaatgttggcattgttaaaagaaccacattttaaagctgggttagctttagagcaaaatgcgttggtgaagttaatgcacacggagcaagctcaggtattaatgaatttgaagcagactgaacgagcaatgaaagagcaatatcagcacttggctcaggtgcgagatgtgcaacaagtaacggtgttgggcagtggctatatgggggcaggtattgcttacttgacggcaaataatgctcaaattcctgtcagaattaaggatattcacccgtcagaaattcaaaaagcgttgcagacttgttatggcttaatgcaaaaagcagtgagtaagaaacagcttagtcacggtgaaatgatccaacgaatgaatttaattacgggcggtgaacgcttagttgcggcgaaatcgacagattttatcgttgaagcggtttatgagaaattagaactcaaacagcaaatggtgcaagagagcgaaaattattacgatgaaaatgcgatttttgccacaaatacctcaacctttgcaatccgtgacattgcttctgtcgccaaacgccctgaaaatgtaatcggtttgcactattttagccctgtgactaaacgtccgatggtggagattattccgcacgaaaaaacttgtcagcgagcggtttcaacggcaattcattttgcgatccagcaaggaaaaattccgatgcttgtcgcagataaagaagggttctttattaaccgtattcttacgccattcttgcttgaagccattgagtgtttatccgaaggggaagggatcgaatttatcgatcgtgccttacaggaatttggctttaagatcggaccgcttgcaatgatcgatgaaattggcttggatattattgttaaatctaatcctgcaatggtgagcgaattgggtaagcgtttcgctttaccgacggttattgagcgtttgacgggagatgatcgtaaaggacgtaaaaataaacgaggcttctatctctacgacacaagaggggcacgcactcaagaggataaaagcatttatcacacgatggaaactattatgcgaaacgatatggaagctgaagacattgcccgtcgttgtgtattgagaatgttaaatgaagcctgttggtgtttacaagatcaagttattcgttcaaccgatgaaggtaacgttgcttctgtatttggggtggatttcgctgatttccgaggcggtgtgtatgcctatattaacaagattggggcaaaagagcttgttcgccagttacgcaagcatacgcaacaatatggcgagcgttttacgccttgtgagtggttggtagaaagggcggaaaaggcataactaaaggctttctaccattttaattgagagataataaagaggaacaacaatgaaattaactaaaatcacccttgctctggctggcattcttggcgttgctgtcgttgggggcagttggtacactggactacaagcagaacaacactatcaacaattggtacaacaaggtaatcaaagccttaaatcactgaagatctatggcatagatgcagaaattaaagatgtgaaatttgaacgccattttttcagttctgatgtgaaatatatcttagaggtaggaacggttgatgagcgttatcagctacaaggcgatgataaactttttcacggcccactaccgttaaatcgtcttagccaagtaaacttaatgcctgcaatgatgagcgttgagagcaaacttcatttacctgaaaaattcaatctacagaccccatttaccgaagggcaaacggatattagctatgcaggtaatttaagcggtgagtttagcctcaatcctttcaaaggcgaaacttgggagctggcaaagacccagattgagttcgagtacaatccagcacaaaaatcaggaaaattcagtagccaaattccgtcctatcaatatcaagatcaagcaaatactaggatagaaatccaagataccctttacaaagctgattttacctcaaatgaaaaataccctgagcttagtttaggcaattatgagttcatttctaaaatggttcgttactcgtttgatggaaaagcaccttttgctttcacaaatctttccagtcagggtaaaaatactttagaaaaggatcgctggacttcaacggggagccttactggagagttgatagctcaaaataaacttaacttaggtaagcttaacattgatagttcgatggagcttgacgcagagagtgctaatgaattaatgcattatgcttcttccctagaaaaattagagtctgcggaagctggtgatgtggtactatcggcttttactaaatcgccgaaattacaaattaaagagcttagcttagagaacgaaaaaggaaaaaatagtctgtctttgaatttaaatttagataaattcgaaccaagtcaattcaaaggaatggaagatgttctaaaaatatttaaagcgtcagtgttagaaactcaattcaagttaccttcgttagaagtattagtgacacagctaaatcaacaggaaggcttaccgaaagaagaagctgaacagaaagcaaaacaaacgatcagtgagtttgcatatcaagctcaagccagctcattagctacttcggataaagatagcctgaaaatgaaattgtccattgatcagggaaaagtcaatttgaatggcagagatgttcctgaagctgcagtgcaaggggcattgtttatgataatgcttgggttaaatcattgataagtaaataggcataagtactactcttatgcctgtaaacaggggttaattttcacgtttcacaataaactcagccaaagcagcaagagccgtagtatcaaaaggcaaggtttctagtgcttttagggctgtctgatagaggctctcagctttttgtttcgccccctctaaccccagcagttttggataagtgcttttatccaacgcttgatctgaacctgcggttttaccaatgacctcactattaccaatcacatcaagaatatcgtcttgtacttggaaagccagcccgattgcttcagcatattgtacaagctgttgtttaatctgatgatcttgggcgtaagcggatagattaaatcccatcattacagaggcaaggatcaacgccccagttttattacgatgaatatgttcaagttcatcaagggcaatggctttatgctcagattgtaaatctaaactttgccccaaacacataccttttgccccagcggattttgcaagccattgcatttgtgccaccttctgctctgaggttagacttgggtcaaatgccagtaattcaaaggcaaagctttgtagtgcatcgccagccaaaatagctgttgcttcatcaaaagcaatatggcaagttggcttgcctcgacgaagggtatcattatccattgcaggtaaatcatcgtgaaccaatgaataggcgtgaatggcttccattgcccctgctgaatggtcaagttgagcaagtggcacacctagcattttccctgtagcataaattaagaaagggcgaactcgtttgccaccaagcaaaacagcataagacatcgcttcaacaagcggtgtgttgtaggctggatattgcgaaagttgctcgcttaaaaaatggttgatacgttgttgatattggcttaattcagcgaaaaggtcgtaattcattatggataatccgtaagatctgaatgttcatctttttgtagcaaaatttggatacgttgttccgctttttgtaagcgttcttgcccttgttgcaccaattttactgcggtttcaaactcatttaaggcttcttctaaaggaagaacgccggtttcaagacgattgacgatttcctcaagctctttgagtgtggtttcaaaatctagggtaggtttctttgccatagtctattccttttcaaataatcccgatattttacttgagaacgatataaaagtagatgattttctgctattgtttatcgcctaaatttagaggggaacttatgcaagtcacacaaatttgtctttatccgattaaatctactcaggcgtatcgggtagagcaggcttttgttttgccacaagggctgaattttgaccgtgaatttatgattaccgaagtagatggaacttttatcacggctcgcaaagaacagatgttatatcgtttagctgcatttcccatttcaacgggaattgtcattcaatctgattgtggcgagcgatgtgtggcactgtataacgattttactcaacagcgatctagcgaagtttggggaagtcattttccatcttgggtggcgaacaaagcggtaaatcaatggttaagccaaaaatttgggcgtgaagttcagctacgttggctaggcgaacagtcacaacgaatggtaaaacattttgaacctcaaccgttaagttttgcagacagtaatccacttttattggtgtctgaacaatccttaaaacaactacaacaatggtcgccagtacctgtttcgatggaacagtttcgagcaaatgttgtcatagatggtattcaagcctttgaagaagaaaggtggaagcaggtgaaaattggcacagtagaatttgaggtagctcaaccttgcacacgctgtattttaatcacccgagatccacagacccttgaattggatccgaatgcagaaccttttcggaccttaaaacaacaccacaccaatgagaaaggcaagcctatttttggagtacatttagtaccacaaacaagcggtgttattcgagttggggattacgttacaattttagagtaatttttatgcaaaaaaatacccgatttattttgtttccgatttttttctttatcggattaaatctcattattttcagtctatcacgccttggtttatccctctggcaagcagatcgtgtttctgcggttgatggctggcttcctcttttcctacaaggcttgcgaatggatattgtgtccatttgttatctctttggtgtaccagcattatttacggtgttattggtgcataacaatgggttaggcacactttggaaaggcattttacgcgtttggctcacgataagcagtgtgtttgttctctttatggaagtcgcaactcctgcgtttattgaaacctatgatttccgcccaaatcgcctatttattgagtatctactttatccaaaagaagtatttacaatgttagccaatgggcatttgactgcggtgattagcagtttggttgcaaccacagttgcaggcattatttattggaaactgtctggctgggctgttcaacatctgcgtttacctagctggaaactgcgtcctgtaatggcattgttgattattgcagtggcatttgctggggcaagatcatcattgggacatcgtggcattaattctgcaatggtggcattttcaagcgatccactggttaattcactggttctcaattcaggctattctgtattatatgccgtacaacagctgaaagatgaagaaaaatcttcagagcaatatggcaaaatgtctgaacaagagatgtttgagattgtaaaaaatagccgtaatcgccccgcttctgattatatttcaacggttattccgacattaaccaagaatgtggcaagctatcaaggtaagcctaaaaatatcgttattgtgctagaagaaagtcttggcgctcagtttgtcggcacattgggcggtaagccacttactcctgaatttgatcaacttgctaaagaaggttggttgtttgaaaatatctacgcaacaggcacacgttctgtgcgtggtattgaagctgttactgcaggttttacaccaacaccagcgcgtgcaacagtgaaattaaccaaaagccaaaacggtttctttaccattgcagaattattgcgtcgtcaaggttaccgcacctctttcatttatggcggtgaaaaacatttcgacaatatggcgagctatttttatggaaatggctttgaaaccatcattgatgagaaagattataaaaatccgaaatttgtttcaacttggggtatgagtgacgaagatttatttgataaagcacacgaaatctttactgaattagcaaaaggcgataaaccgtttttcagcttagtgtttacttcgagtaaccacgatccatttgagttcccagacggtaaaattgagttgtttgataaagagaaacagactcgtaataatgcggcaaaatatgcggattatgcgttagggtatttctttaaattggcgaaacaatcaaattattggaaagatacggtattccttgttattgcagaccacgactcgcgagtggcgggcgatagccttgtgccaatcaaacatttccatattccagccttaattttaggggaacatatcgagcctcgccgcgataatcgtttggtcagccaaattgatatgccaacgacattattatctgttgcaggcattagtggcgattatccgatgattggctttgacttaactcaaaatgtcgatccaaatcgtgcgtttatgcagtacgaccaaacgcaagcaatgatgaaaggcaaagatgtgattattcttaagccaaatcaatctcctcaaggttatgaatatgataaagcgaatgaacgccttaacccaaaagagcagtctgaagcaatgaaaaaagaggcactggcccacgcattgttaggcagttatttatataaacatcagttatataaattgccgaaagatgttgaatagcaagtaatatttaatttttagtaaatataggtataaaaaattatgagtattcgtattttactccaagaagaaattcaacaagctgcaagctcttttcacaatccgccgttgttgtatgccaatcctaaaaatttatatgctcgccgagctaaacgtttaagacaattggctgaacataatccttttggggattatttggaatttgtggcaaatattgtcgaggttcagcttgatttattagaaaatcagcctattgcaaatagagtgggcgaacttaccgcttatttggaagctcatcagggagtgaagcctttagatgtgaaaacttttaagcggtcagatgagtggcagaaattgctgttggcgtttattgataagtttaagccttatgcgtcggatactgtgttggcgacattggaatggttagagaaagcctcaaattctgagcttgaaatgctggcggatcatttgttgaatgagcgttatgaagaggtgggtgcagacaaggcggttttcttatgggcggtcttgtcgctttattgggtgcaattaactcagcaacttcctcgcaataccaaagcggagtacggtgaagaacgccatacttgccctgtgtgtaactctgccccgattgccagtgtggttcattttggggaaacgcaaggtttacgttatttgcactgttctctatgtgaaagcgagtggaatatggtgcgtgcgaagtgtagtaattgtgagcagacaggcaagctcgattactggagcttagacagtatggacgcagcggtgaaagcggaaagttgtggtgattgtgagagttatctgaaagtgatgtatcaagataaagatccgcatgttgagccaatcgccgatgatttaggtacgcttttccttgatgctgaaatggagcaaaaagggctggcacgcagtgcgattaatccttttttgtttcaagtagaataatttttatacatatttattgactacatagcaactgtgtaagaatacagttgctataagtagaatctaggaagcgtggtgggtagcgtaaatttctaagcgttttcgtttttagggaacatcccccaacgcattttcatttttcgtgataaacattgcgtcaccgtagctaaagaaacggtattgactttcaacggcgtgttgataagcgttcatacagtttttgaagcccgcaaaagcagaaaccagcataatgagggtggattctggcaagtggaagttggtgactagggcatcaacgatacggaaggtttttccagggtatagaaaaattgttgtgtctgaatagaatggggcgattaatttgccttctttttctgccgcttgtgctgcactttcgatagagcgaacagaggttgtgccaacgcaaatcactcgtttgccttgtgctttggtggcaagaattttatcgacaacgtcctgcgatacttcggcatattctgcgtgcattttatgttcttcgattgtttctactcgcactggttggaatgtgccagccccgacgtgtaaggtaacaaaggcggtttgtacccctttttcttgcagtttttgtagcatttgatggtcaaaatgcaagccagccgttggggctgcaactgcacctaacactttgctatataccgtttggtaacgctcttggtcggcatcttcatctggacggtcgatataaggcggtagtggcatatgtcctgcctgttgtagcagatcgaataaaggctgtgacgcttcaaatttcagctcaaataacgcatcgtaacgagccaccattatcgctttaaagccatttccttcgcctaatttatcttcccctagaaagatttcagcattctctttcggggcttttgatgaacggatatgagctaaacagcgatgttcgtctaatacacgttccaccaacacttctaacttaccgccactggctttgcgtccataaaggcgagctgggataacacgggtgttattaaaaatcagtaagtcaccgctatggatatgttcaagtaaatcattgaattgttgatcttgatattcgcctgtattgccgttgagataaagtaaacggcttgcacttcgttcagccgttgggtagcgagcgataagttcatcaggtaggtcaaaatggaaatcggttacacgcacaacagttcctttaaataatagggacgccacacttagcgtccaataaatataatatgagataaataaagccgtgaatttatagtgaaattcaaccgcttgcaagcctaagattgcgattcttctacattaggcaaggcattgatcaccgctttgactaaagttgctaatggaatggcaaaaaataccccccagaagccccaaagaccgccgaaaataattacggcaacgatgatcgttaatgggtgtaaatttactgcttctgagaataaaaatggcacaacaaggttaccatctaaaagttggctaatcacaaaagcaagtagcaagtagtagaaatcaggggataagccaaattgaaagagtgcaactaacgcaacaggaattgtcactaataccgcaccaatataaggcactaataccgataaaccgaccgctactgagagtaacaatggatagcgtaaatcaaagaaaaggaaaataatataagttacaacgccaacaatgagaatttctaaaaatttcccacgaatatagttggcgatttgtaattgcatttccccccaaacacgagtagcaaggtggcggtttttaggcataaaacgtagtgcagaacgcataaacaacgttttatctttgagtaagaaaaagaccattaaaggcactaaaaacgcataaatacccaatccgacaaggctaacaagggagttgaatgaaaacgacaataaggagtcgccaaaggtaagaattttagtttttgccgttgccattagggagtcgagcattgcatagtcaatcaattctggatagtgttctggcagagcctcaagccacgcattgagcaagttaaacatactcggcaggtcttttaggaaggtcactgcttggttccatagacttggaagcattaccacaaacaaaaagacagagagagaaataaatccgcctaagacaatcactaagctgagcattcttggtaatttgagtttggtggttagaaagcggataggccattctaaaaggtaagcaaaaacaatggcaatcaaaaggggcattaagagatcactgaaaaagtagatcgttccaaagccgataattaagatggcaagaagtgcgacaatttgtggatcagtaaatttctgtttataccaatccttgaacatttcaaacataatctatcctgtcgtgttttgcgtttatttattgttatgatgataaaaaaaggggcgtttaatgtacctactatggatcactgacaaatatcaattaacaagataatgttgttttgttgtggtagggacacactgcgtgtgtccgtttttaaggtaaagataaaatatctcgtacccttaccacaatggacacgctcagcgtctccctacatttacctctttttcgttatttacattatttttgactacaaaccgcaataaagcctagttgattttcagggtcattaaaggtctggaacattttcttgaaagtatcacggttttccggttttaacgcattacccaccactttcattgcccctaaaaccccttcatcttgaattaacccttttggagataacaagctcatctcaccactaaaggtttcaacattgcggaagccacaatgaaggaatgtatctttccaatcctgcttatttaagggtgctacggtgatattaatcgcatcacgcaacttagcgatcacctcttcgctgttatcgccattgagcagtaaatcgtgggtaagtaataaaccgtttggctttaatactcgcagatattcacgaattgccttttctttggcttcttgcggtagcattgtcagcattgcttcgttgataataatgtcgaaactattatcttcaaatggcagtttggtggcatttgcacgttgaatttgcactaattcttcaactttatgctctttaatgttgtgttgtgctttttctagggcttcttcatcaagatcgataccgatcacttggcaaccaaattgttgagcaatttcgattgcggtccttcccatattacaagcaacttcaagcacttttttatctttccgaaaatcgccatttgcaatgagccagtccgttgccactttgccacctgggcgtaaacgtgttttacccaaacgagctaagaaatggtgtccaacttcttcttttttcatattcacctctttggattttgtaaaattctgcttaattcagaccgcttgcattgaaaagaagttcaatttaggctgaataacgccgtagattataccgtttttttatctgtgcatatatacaattaaacagaaatttggcaaaatttcgcacatatcttccaacaacactgaagatataccattcttgttttaacaaaaaggaaaaataatgaaaaaatcaacaaaatcagaatgctatgcccatcagcgtggcgaaattcaagagagtgcaattaaagccttggtgacggataaactgtttagaagtcgagtagagcgaaaccgcaaaggtaaaggaagttatcagcgtaacgcaaaacatcgcaaaggggaaaacccatttaaaagtgttcagcagaatgtttttaaatgggtttttcttatccagaattagggttgtttaatttggtattatgtagcagttgtataaatatcttaattttctgctacaattccgttatctttatttaggttaaataagaacaaagaggcaactatgcaaaacgaacccattcgcttaacgcaatatagtcacggtgctggctgtggctgtaaaatttctccgaaagtgcttgaacaaattctgcacacagaacaggcgaggtttatcgatccgaatttgttagtcggtaatgaaaccaaagacgatgcggctgtctatgatatcggcaacggtgttggtattgtcagcacgacagatttctttatgccgattgtggatgatccttttgatttcgggcgaattgctgcgactaatgcaatcagtgatatttttgcaatgggcggtaaaccgattatggcgattgcaattttaggttttccaatcaataagttacccgctgaagttgcacaaaaaattgttgatggcggtcgttttgcgtgccaacaagcaggcattgcgttagctggtggacactcaattgactcccctgaaccgatttttggtttagcggttacaggaattatttctaccgaacaagtgaaaaagaacgcttcagcacaagcagactgcgatttatatctcacgaaaccactcgggatcggcgtattaactaccgcagaaaaacagggtaaattaaaacctgaacatcaaaatttagcacgagatgtgatgtgtcagatgaatttggtcggtgctgaatttgccaaagtcgatgaaatcactgcaatgaccgatgtcacaggttttggcttgctcggacacttaacggaaatctgccaaggttcaaacttgcgtgccgaagtttatttcgatcaaatccaaaccttagacggtgtcagagagtacatcgcacaaggtgctgtgccaggcggaactacccgtaatttcgacagctacggacatctaatttcgccgttaagtgatgaacaaaaagcgattttgtgcgatccgcaaacatcaggcggtttattaattgccgttaagccacaagcggtcgaaagcgtgaaacaaattgcaaaaaatgccaatgtcgccctttaccctgtcggcagattattgaaagcggaaagtggtaaggtattgatcgacgtgaaatagtagggacacactgcgtgtgtccttcccttgaaaaatgtagagatgttttggcggacacactgcgtgtatccttcccttgagaaatgtagcgatgttttggcggacacacgcagtgtgtccctacattaaattttgagaataaataagatatgaaacaaaacattgatgtggtaattgtcggcggtgcggtgacggggtctgtacttgccttagcgttaagttcagtaagcggacaccaattgcaaattgcaatcgtagaaaaaaatgagccaaactatgcacaacaaggcggttttgacgcacgttcaatcgcctttgcttacggcagtttgcaaaagttagctcaaattcgaccgcttgccacggaacaaaatttagctcaactggtttaccgtattgcaacccccatcaaacaaattcacgtttcagatcaaggacatttcggcaaaacgaccttaaaagccgacgaattacgcttatccgaattaggtgtggtggtggaactcgccaaactgggcgagcaactgaccgcattaatcgccaagcaacccaacattcagctattctgccctgataccgtctcccatatcgaacgcacagaacagcaatgccagattaccctaaatagcggaacacaattaacgtccaaattgttagttgcctgtgacggcattcaatctcaagttgcccaacaatgtggcgtaaccacccaatttatcaaggattatcaacaatccgccattattgccaatgttatcctgtctgaaccacaccaaaaccacgcctttgaacgtttcacaaaacaggggccttttgcattattaccacttaatgaaaaaatgatgtcgctggtttggtgtatggaagatccgacagaagcaatggcaatgtcagacagcgactttttacacgccttgcaacaacaattcggctggaagctcggcaaatttttacaagtcagcaagcggtttgtttatcccctttcttcacaaaaaagcgaaagccatattcaccaccgactagccattgtcggcaatgcctcccagttactacaccctgtcgcaggacaagggttcaatcttggaatgcgagatctatttgaattggcaacccttgtcggtcaagcctttgcacaaggcgaagatttcggcgaagcaaaatggctacaacagtttgaacaacaccgccaagccgaccaaacccgaattatgcaaagcacaagcggtctgattttgatttttggttgcgaatttttgcctattcaagtcgctcgtaaccttgccctatttggtttatctcatttttcactggctcgcaatgccgttgctcataaagcattaggctggtaattttcggtatatgtttaatcaacttcaacatcagttacacaaattcgtacaacgtggtttagataatcatctacgccttgccgtgacaggcttaagtcgcagtggtaaaactgcattcatcaccagttttgtcgatcaactgctacacattggcacaggcgacaacgcccacttaaacctatttgcccctgctcgaaacggacaaattctttccgtaaaacgagtagaacaacacgatctcaccattccccgttttgaatacgacaaaaaccgccactgcttcgagaacgaaccagcgacttggtgtccatcgactacggggatcagcgaaattcgccttgcgatccgctaccaacgccgagatagcctgcttcgccatctcaaagaaacgagtacactctatctcgatatttttgattacccaggggaatggttattagatttaccgctactctcacaaagtttcaaagagtggtcgcaacatcaacagctggtacacaaaggcgagcgtgcagagttagcacaggcttggcttgcacaagtaaaacaactcgatctcaccgccaaaacagacgaaaaccaacttgcaaaattaagtgaagattacaccgcttacctactcaaatgcaaagaagttggaatgcaatatatccaaccagggcgatttgtcctgccaaataccgaacggggtgcgcctgtctatcagttcttccccctgcttgatttaagcgaaaatgaatgggaacagctagaaaaaagccctgaacatagcatttttcacaccctgaaaaaacgctatcgccactatcaacaaaaaatcgtcaaaccattttatgaagattacttctcacagtttgatcgccaagtgatcttagcggattgccttaccccgttaaatcacagccatcaagcctttattgaaatgaaaacaggcttacaacagctatttaaacatttccattatggcaaccgctcgctttttagtcgcctattttcatcgaatatcgacaagttactgttcgttgctaccaaagccgatcatatcaccagcgaccaactaccgaatttagaaagcctaatgcgacaattagtgcaagaaggggggcgacacgctgaatttgaaggcattgacacaggctaccaagcgatttccgctatccgagcgaccgatccagtgatcgccacacaaaatggacaaagtttcaaagcgatccgtggggttcgctctagtgataaaaaactggttacactctaccctggtagcgttccaaaccgtttacccgacatcaactactggcaaaatcaccgttttgaatttgaccagtttgaaccgaaaaaaatcgactttgatcagccaatcccccatttaagaatggacgctgtattgcaatttttgctcgcagataggtttggttgataaattcccaacagaatagtgttagtaagcaaatgtaatataaaaaatttgggcatttgctacataataggctggatttaaggtacaatctcaccaatttttttaataaaaaatagcactatgagtaaaaaaccaaaagtagcttcaaatacgattgccttaaataaacgtgccagacacgaatattttatcgaagaagaaatcgaagctggtctagaattacaaggctgggaagtcaaatccctgcgagcaggtaaagccaatatcggtgatagttatgtgacatttcgcaacggcgaagcctttttattcggtggcactattaccccgttaaatgtcgcttctacccatattgtgtgcgacccaacccgtacccgtaagttattgttaaataagcgtgagttagacacgctttatggtaaagtcagccgtgatgggtttaccgttgtcgctctgtcgctttactggaaaaatgcgtgggcgaaagtcaaaatcggcttggcgaaagggaaaaaattgcacgataagcgtgaagatattaaagaccgtgagtggcaagttgctaaacagcggattatgaagaatgcgaaccgtgggtagtattacaagcggtaacatttctataaaattttgcaaaagtaaaaggacacaaaaatgatcgaccaaaaccttctacgtacgaaccttgaggaagtcgcacaaattttaaaactcaaacgtaacttcaaccttgatgttgctcgtgttactagccttgaagaacaacgcaaagcattgcaagttaaagcagaaaatttacaggcagaacgtaatgctcgttcaaaaaatatcggcgcagcgaaagcgcgtggcgaagatatttctgcattattagcagaagtggacacgatgggtaacgaattagatgcagcaaaagtggaattggataaagtccaagcggaaattcgtgaactgctattaaacattcctaacttacctgccgatgaagtgccagtgggtaaagatgatagcgaaaaccttgaagtatctcgttggggtacgccacgtcaatttgactttgaaatcaaagatcacgttacccttggtgaaggcttaggcggtttggatttccctgctggtgtgaaattaactggaagccgtttcgtcgttatgaaaagtggtattgcacgtttacaccgtgccttatctcaatttatgttagatttacacacagaacaacacggctatgtagaaacctatgtgccttatcttgtaaaccacgataccctttacggcacagggcaattaccaaaattcggcgaagatctgttccatactcaaccgttagaaggacaagatccaaatgcggtacaaaaaccttacgctttaatcccaaccgcagaagcgccagtcactaatcttgtgcgtgatgaaatcttagacgaagaaagtttaccactgaaactgaccgctcacaccccgtgcttccgttcagaagcaggctcttacggccgtgatacccgtggcttaattcgtatgcaccagttcgataaagtagaaatggtacaaatcgtcgcccctgaaaaatcaatggaagcccttgaagaattaacaggacacgcagaaaaagtgttgcagttgctcaatctgccataccgcaaaatgttactctgctctggcgatatgggctttggttcaagcaaaacctacgatttagaagtgtggctgccagcacaaaacacctaccgtgagatttcatcttgctcaaatatgtgggatttccaagctcgccgtatgcaagcacgttgcaaagcgaaaggggataagaaaactcgcttagttcacaccttaaatggctcaggtttagctgtcggacgtacgcttgttgccgtacttgaaaactaccaaaatgcagatggttctattaccgtgcctgaagtgttgaaaccgtatatgggtggtgtagaggttattaaataatccctacaagcgatctctttttatcaatttattaccaaagtaggggcggaccgatgtgtccgcccttgtttcgtattgtttaggaggagatatcactctgctcctatgaagtaacttagagctattatttcactatagtagataattaattttcaaattaagcatttatctaattttattttttgaggtaatcaatggcagcagaaggtgcaagtcaattagttagtgtagtgacccttttaggggcggcaattattgcggtacctatttttaaacgtttgggcttaggctctgttttgggatatttagctgcagggcttgcgataggtccttttggtttaaaacttttctcagatccccaagcgatcattcacgttgccgaattaggtgtcgtgatgtttctgtttatcattgggttagagatgaaaccatctcacttatgggggctgcgtcgtcaaattttcggcttaggcagtatgcaagtggtcgtttgtgcggtcttgcttacgtttgttggtatggctttcggctattcttggcaaatttcttttgttggtggggcgggctttgttttaacatctactgcaattgtaatgcaagtgttgagcgaacgagacgatattgctagtcctcgtggtcagcgaatggtgtcaatcttgctttttgaagatctgattattgtgcctctactagccattgtcacctttcttgcaccgacagatccaaatcatattgccgatccccaacctatttggcagaaaatcggtatcgcagggttatctgtgaccgcattggtggtggtcggtatttgggtactcaacccgattttccgtattctagcaaaaaccaaaatccgtgaattaatgacggcagccgcactatttgtggttttaggctctgcgttattaatggaggaaggtggattatcaacagcaatgggtgcttttgtcgcaggggttttactctccgaatcaagtttccgtcaccaattagaggccgatattgagccatttagagggttattacttggcttattcttcttaggtgtgggaatggcattagatctaaacattgtgtttgataactgggttctaatcctttcggcagtgattgcaatgatggcagtgaaatcattgtgtattttattaatagccaaacttgctaaaagtagcaccagcgatgcaatggatagagctgttgtgatggctcaaggtggtgaatttgcctttgtactatatgcagcatcggcaacacaaggggtgatttctgcagaaattcaagcaaatctaaccgctattgtcgtattttcaatgatttttgccccaatcaccatcattttacataacaaattcgtagcacctcgttttgcaaacaaagctggggaacgtgaagccgctcatattgaagaacagcacccgattatcttagttgggattgggcgttatggacaaatcgtcaatcatatcctcacgatgtctggctatcaccctactattattgatcttaacgaagcgcaaatcgaaggggcgaaaaagtacggaattaaaagctattatggcaatgctactcgtccagaattacttcacaatgcagggattgaaactgcggaattattaatcgttgcggtagatgataaacatcaagcgatacatattgtggagctggctcgttctatgaacccgaatatcaaaattatcgcaagggcatacgatcgagttcatgtctttgaactttacaaagcaggagcagataaacaagtgcgtgagacctttgattctgccttacgcagtggacgtgcggccttaaaaatgctaggtgttgaggaagaagttgctgatgaaatttgtgactactattttgaacgagatcgccataatgtgaaattaatggcggaagtctatgatcctaatttagaactctttaagaatgaagaaatgcgaaaaattgcactagctgaagatcaggaaacaatgctcgaaattcagaatattttggaaagagcaagggagaaaaaagaagctgggttctttaattccccccactaaatataagaaaaggttctgaagatagtttttctgtgtaagacagtaaataattgctctaaagagcaagtttcatcgtaaagattaaacctaatctgccagttctataattacagctcctgccagattaggcatgcttctacggttctgatcaacaagcggttatttatttaacaccgcttgcaacgctaccccaatgtcagccaaactacgcacagtttttacgcctgcggcttcaagagctgcaaatttttcatctgcagtgccttttccgccagagataatcgcccctgcgtgtcccatacgttttccttttggtgcggtaacgccagcaatatagctcaccacaggtttagtcacgttcgctttgataaaggctgctgcttcttcttctgcggaaccaccaatttcaccgatcattataatcgcttcagtttcggggtcagcttggaatagtgttagaatatcaatgaagtttgaacctggaatagggtcgccaccgatcccaacacaagtcgattgaccaaaaccgtagtctgttgtttgtttaactgcttcataagtcaatgttcctgaacgagaaacaatcccgattttaccttttttatgaatgctgcctggcataatcccgattttgcactcatttggggtaatcacgccagggcagttagggccgatcattctcacgcctgtttggtttaaacgctgtttcacttgaagcatatctaaggttgggataccttctgtgatacaaacgacaagctgaatacctgcatcaatggcttctaaaatagcatctttacaacccggtgctggtacataaataaccgttgctgtcgcccctgtagcttccactgcttcacgcacggtattaaatactggtaaacccaagtgcgttgtgccacctttgcctggtgaaacaccgccgacaagttgtgtgccataatcaagggcttgttgtgaatggaatgtgccttgtccgcctgtaaaaccttggcagattactttggtatctttgttgattaaaatagacattatttaccccctgccgcttttactgcttctacagccgcatctgttaaggttgctgctgcaatgatatttaagccacttttcgctaaaatttcacgtccaagttctgcgttgtttccttctaggcgaacgacaacaggtacgtttacccctacttcattaacggctgcgataatcccgtcagcgattaagtcacaacggacgataccgccgaaaatattgacgagaacagctttcactgctttgtcagacaagatgattttaaatgcttccgcaactcgctctttggttgcaccaccacctacatctaagaagtttgctgggaaaccgccgtgtaatttgacgatatccattgttcccattgcaagtccagcaccgtttaccatacaaccgatgttaccatctaaggcaacatagttaagttggtgcgactcggcaagggcttcacgcgggtcatcttggctaggatcgtgcattgcggcaagttcaggctggcgatataacgcattaccatctaccaccattttggcatctaagcaaagtaaattgccttcagtggtaacgacaagtgggttgatttcgagtaaggaaagatctttttctacaaagagtttagctagctgtgtgaaaataaaactaaattgcttgatttgatcgcctgttaaaccaagtttaaacgctagttcacgcccttgatatgccattccacctacaagcggatcgatagcgactttatgtagcaattcaggggttttagccgcaacttcttcgatattcattcccccagcacttgaagccataaaaacgactttttgtgatgagcggtcaattactgcccctaaataaagttcacgggcaatccctgctgtttcctcaacatatagggtattaacaggctgaccatttgcgtctgtttggaaagtcactaagcgtttaccgagccatttgtctgcaaattcacgcacttctgcttcattccgtaccagtttgacaccgccagctttaccacgaccgcctgcgtggacttggcatttaattgcccaagcatcgcctttgagttgtttgattgcttcaaccgcttcatctgctgttttacaagcaatgccttggctgacaggaagtttatatttggcaaagatctgtttgccttggtattcgtgtaggttcatagagttagggttcctatgtgattaaaactgttttcccccctttttcaaagggggaaatgttcattctaaatttctaacaacaaacgtgttggatcttcgagtaaatctttgatggctactaagaaaccaacagactctcgtccatcaatcaaacggtgatcatagctcaatgcaagatacatcatcggacgaataaccacctgaccatctacagccacagggcgatctttaatagcgtgcatacctaaaatagcactttgcggtggattgataatcggcgtggacattaatgaaccaaagacaccgccattagtgatagtgaagtttccacctgtcaagtcttctacagtcaatttgccatcgcgtcctttttctgccagtgctttaatggctttttcaatgtctgacattgaaagtttgttgcaatcgcgtaacacaggggtaactaaaccacgaggggtagaaacagcgatactgacatcaaaatagttgtgatacaccacgtcatcgccatcaatagaagcattcacttcgggataacgtttcaatgcttccactactgctttgatatagaatgacataaagcctaaacgtacaccgtgttgtttttcaaatttttcaccgtattgcttacgcagatccataataggcttcatatctacttcattgaatgtggtgagcatcgccgtagtatttttcgcctctaataaacgttctgcaatgcgtttacgcaagcgggtcataggcacacgtttttcactacgagcagagtaagccactgtgctgatcgtattttcaactttctcagccactttcgcattacgtttagccacaacagcttcaatatcttcacgagtaattctgccacctacacctgaacctttcacctcactagcttctaaaccgtgttctgcaagtaaacggcgaacacttgggcctaatgcgtcagccgagctattatctggctctaaagaggcggtttgacgatctgaaggggttgcttcatttactggtttaattgtcgctaaagacacatcacctgcttgttgagtaactaaaatacctaaaacttgtttacttacaacagttgccccttcgccttgttgaatttcggtaatcacaccatcgctagtcgcaggcacttcgagaaccactttatcggtttcaatttctacaataacttcatcacgttttacgctatcgccaacttttttatgccaagttgcaacggtcgcatctgcaacggattcgggtaaatctggaacgaggatttcgattgtcatttgttgtttccttttctaatttagttctcctcccccgtttacgggggaggggtgggtgggggaattgcaacgaagttgcaacatttgagctaaactcaccgcttgtttccccccttccgccttcggcaccttctcccgcaagcggcggaagggaacttataaaattaacgtgttaatgcctcatcaaccaactgcgtctgctgtttggtatgaagtgacatatatcccaccgctggtgaagcggaagctgggcgacctgcatatttcaatgtcgcattctctggaatagaggcttcgaagttgtgtttgctacaataccaaaccccttgatttaatggctcttcttgacaccaaacataatcagtaacatgagcataaggcataagtgcttttttcacatcttcatgtggataagggtaaagttgttcaatacgaataatcgctacatcggttttcacacgctggcgacgttcttctagtaaatcgtaatagactttacctgaacaaagtaccacacgcttaacctgtgcaggatcgagattatctaattccccgatcaccgttttaaactcaccgttgatcaactcatctaaagttgaaacagcaagcgggtggcgtagcagtgattttggcgaaatcgcaatcagtggacgacgcattttacggatcgcttgacgacgtaacatatggtaaacctgtgctggtgttgatggaatacagacttgcatattttgttctgcacaaagttgtaagtaacgttccaaacgagctgatgagtgttcaggaccttgaccttcatagccgtgtggcagtagcatcactaaaccgcacatacgtccccatttttgttcaccagaactaataaactggtcgataacaatctgagcaccgttcgcaaagtcaccaaactgagcttcccaaatcgtcaatgtttttggatcggtcgttgcataaccatattcaaatgccagtaccgcttcttcggaaagtaccgagtcccacacctcaaaacgcccttggtttgcgtgcaaatgcgttaaaggcacatagcctgtaccatcattttgattatgcacaacagcgtgacggtggaagaaggtaccacgaccagcatcttcacccgatagacgaacgtgagtaccatcatcaagcagggttgcataagccatcgtttcagccataccccagtcaagcagtttattgccttgatacatctcacggcggtcgttataaattttttcaacacgagggtgtgggcgtaacgcttctggatattcgcacacacgtttcgcgatttctaagaaacgagcttcagggaatttgctttcatacggcgacgtccattcataattaagatattgcaaccaatccattgacgcagtatccatttctcgccattcaggcacaacacgatcaccattatctaacgcatcacgatagaggttcatcatctcaatttcatcatcacctgtaatcaccccttcagcaatcaaacgatccgcataaactttacgaggtgtagggtgtttcttaataataccgtacatcatcggctgagtagccaaaggttcatcagcctcattatgaccgtgacgacgataagaaattaaatcaataaaaatatcacgtttaaataaacaacgatattccaccgccattctcgctgcaaatgccaccgcttcaggatcatcaccattaacgtgaataatcggggcttggatcatcttggcaatatcggtacagtattccgtagaacgggtatcgtttggattagaagtcgtaaaaccgatctggttattgatcacgatacggattgttccgcctactttgtaacctctcgcatttgacatattcaaggtttcttgaacaaccccttgacctgccaccgccgagtcgccgtgaaccgtgatcgccaatactttcttatgttcagtatcgtgaatacgagtttgtcttgcacgcacagaaccaatcaccacagggctaacaatttccaagtgcgaagggttaaacgcaagagcaaggtgaacgtgtttaccgtccacatcaaaatcagacgagaagccctgatggtatttcacatcacctgtacgattatcatcggcgtgtttaccagcaaactcatcaaaaagttcagcaggtttcttacctaacacattgactaacatattcaaacgaccacggtgagccattcccatcactacatcttccataccttgacgaccagcgtgacggataatctctttcatcatcggaataaaagcatcagacccctcaagcgagaaacgttttgcaccagggaatttcgcccctaaataacgctccaaaccatcagcagcggtcagttccgttaataaatttactttttcttctttagtgaacaacggcttattcagcacactctctattttcgcctgaagccaatttttctgctccatatcctgaatgtgcataaattccaaaccgatactaccgcaataggtttcctttaacgcctcagcaagttcgcctagcttcatcgtatctttgttataaacataacgcccgatagtaaaggtttcttctaaatctttatcactgaaaccgtggtaacggtaatcgagttcaggaacctgtgaggttttccaacgataataattaagcggatctaatttagcttccaaatgtccacggaagcggtaggcattaatgaactgtaaaactttaacgagttttgcactggcttcaggatcaatcactgtcaccgcctcactgcgattttcacgcgctaagcgacggaaataatcacgaacgctggagtgaggttgctctacttgggtagcttttggcagttgagcaaataccgcttgccaacttgcatcaacgctatcagtatcttctagatactgctcgtagatttcctcaacataagactgatttgccccacctaatgcagtagttgcaatccaatcgtcaaagtttttatgttgcataaagacctaaccttatttttatctatttacaaagttgttaaatttgctgccattatatacatttcagtacaaataaaggcaaaaagtcaaagagaaatgcttacttataaatcagtcacacaaatccccccaattatgacggattttttaaagaaaaactgtgatataagtcgaatttttacaaaaaattaacattataaagaggatggttgatgatagaagaatagaaataaagggcgactacttcattcaataagtttcactgtatacacgattaaactaaatgcaatgccatacataattaaccctgtgacaaaatctaaaatctgccaagttcgacgtttttcaaagtaaggggaaagtaaaccagcaccataaccgaccccaaaaaaccataaaaatgaacaaattaatgctccaagtaaaaagtgtattttttctgtgaaacttaaagtgccgccaataccaccgacaatcaccacagtgtcaatataaacgtgtggattaagtaatgtaatcgcaagggtaatggcgatcactttctttaaagacgacttagcttgcccttgttgtgccaatagctgacttgagccttgataagcagtaataaaagagcgactaccataagtgaataaaaaaatcgcaccaaacagagcaagcaataaactagcggtaggtgactgcgaaataagcgaaccaagccccaatacaccgatactcatcaacgcaacatcacaaagaaagcagagtagagctacccaaaaaacgtgctgttttaaaatcccctgcttcaataaaaatgcattttgtgcaccaatagatacaatcagcccaaaacagaccacaaaaccgtgtaaaaaactttccatcacttaatttctccctcatacaagcggacgattatacccaaatatttcatatatttgtcgaggttattcgttgaattttgtgtggggctatgtcagacactaatttattggaggaaggtataaatgagcacagatagaaattctccatttttattcaatagtagaatggagaatttccaaatgtctagagagtgtatcttagtctattagttataaaatcattttataactaacaacttactcgcattactcatcatatccgctactttcggctgagaagataattgcgtttcgttcattggttcaattttccaaatatctttcgcataatctaacacagagcggtctgatgagaagtagcccatattcgcaatgttgatgatcgcagaacgtgtccacgctttcttattacggaagtaggttgccactttctcttgagcatctacatagctacggaaatccgcacaggcttgatagaagtcacctgatgagagaattaactcttgataacgatatggatcttctggtgagaatttaccatttaagatttgtgaaattgcttcgtttaattctgcatctttttcgtagtagtgatatggtgagtagccgttgcgacgtaactcttccacttgttctacggtgttaccgaagataaagatgttgtcgttacctacacgatctaaaatttccacgtttgcaccgtcaagggtaccaattgtcaatgcaccgtttagggcaaatttcatatttgatgtacctgatgcttctgtaccagcaagggaaatttgctcagacacatctgctgctggaataattaattgtgcaaggcttacgctgtagttcggaataaagacaactttgattaaatcacgaatatggctgtcgttgttgatcacatttgcaacatcgttgattaaacgaatcacttttttcgctgcatagtaagcacttgctgctttacctgcaaagataaagacgcgtggctgccaatctgctgttgggtttcttaaaatacggttatagtgagcaatgatgtgtaacacatttaattgctgacgtttgtatttgtgaatacgtttaatttgaacgtcaaaaatcgcttcagggttgagtttaattccttgagtttgttctacataagcggcgagtttacgtttattttctactttaaccgcagccacttctacttgaacatcagtatcatcaacaaaggcattgaacttgtctaactgagttaaattggtacgccattctttgccaatacgtttatctaaaattgcagcaagtccaggattagcgatatgaatccagcgacgtggggttacaccatttgttacgttggtgaagcgatctgggtagatcttcgcaaaatcggcaaaaatagactccaccattaagtctgagtgaattttggctacgccattgactttgcctgatgcaatcacggctaaccacgccatacgaatacgacggtcgccttgttcgtcaataatagatacacgacggattaattcttcatcatttgggaattgctgacgaacctcttgtaagaaccaatcgttgatttcaaaaataatttgtaaatgacgtggtaagatacgagccaccatctccacaggccaagtttctaacgcttcgctcattaaagtgtggttggtgtagaagaatactttgcgagtcgtattccatgcctgttcccaactataacctttttcgtcaattaaaatgcgcattaactcaggaatcgcaagggtagggtgggtgtcgttaaggtggattgccactttttccgcaagatttaagcaagatcccgattccacttcatgacgacgaacgatgtcttgtactgatgcagagcaaaggaaatattcttggcgtaaacgtaattcacgaccgttgtaagttgaatcgtctgggtaaagtacacgagaaacgttttctgagctattttgttggctcattgctgcaaaatagtcaccacggttaaagtctgctaaaccaaatagtttttcccctgcgtgtgcagaccatagacgtaagctgttggttgcagtggttttaaatcctgggacaagctggtcgtgggcttgagcaatgatttcttcatcaggttgccatacggtttttttgccttcttgccaagttctgccaccaaaacgtatagggaattttttacttgaacgtaagtaaggccacgcaaattcattttctaaccaataatctggattttcaacttgttcgccattttttatctcttggcggaacataccgtattcataacgaataccgtagccaatcgcagggatcttcattgctgcaagactgtccatataacacgcagccaagcgacctaagccgccgttacctaagcctggatcgccttcttcattaataatgtcttcaagattttgacctagctcgtcaaacgcagctcgaattagatcataaacaccttctgcaatcatagcattactgaaggttcttcccattaaaaattccatagaaagataataaacacgacggcttgtatttgccgcttggctacgacgagtttgtaaccaagattccgtagaaagatcacgcacaacacgcaatgccgcatttaaccagttacgtttgcttgcttcacgcggttctacaccaagagcaaaaacaagtttatgcaaaatggcatttttgacattttgaatgctctcagggctaagatgcgtgtttgactgagcgatagtcattcattactcctattaaataaaacgatagaaagaataaaaaaacgacgcattttacaatacttttgtgaagtttcttaccaaattacgaaaaattacgcttacttactgaactatactgttgaaaaagtagaaacagcgaagtaatgtttgatttttcttaaattttcattagaatacgcactcggttttttaaccgtcaaatttagggaaatagctgggtcgcctgctatttttgtatcaatggaaccttaggttccctttttatttatgagaatttaattatgtcattcaaatttgaagctgaagttcgttcggcgcaaggtaagggtgcgagccgccgcctgcgtcacaatggtcaagttcctgcaatcatctacggtggtaaagcagaagctgtatcaatcattttagaccacgataaagtaaacaacgcacaagtacacgatgcgttctacaacgaagtgttaactatcgttgttgcgggtaaagaagagcaagtaaaagtacaagcgattcaacgtcacccaactaaaccaaaacttgttcacttagactttaaacgtatttaaccccatgtagttaaacactatttctcagactttgtatctgttagtttttttaatttaaagtcagattactacgagatagtttaggaataaatttcaagtagttccaagccccttttatcagcggataaaggggcttttaactataataaataggggctagataactaacttaaaccgcctttaactaattatgtttaaatggaaatttgagctttaagttactgtgattaaaacgctatttgcattccttcaaatacaattccaaatgtactttggaaatactgttaaacttgagtaaatgacgtttatcttggctctaaaaatgctcaattctgtttatatggttttgtttttctatggagtggtataactcagtgccacagtcagtgaatgctttgccgttgaagattctgtattaggtatgatttcaggcaaagcagcgaatatgaaaactgtcgttattcctgctaaggtagagtgggatgatccacgttggtcgttggcagattataagttagagcagatttctgacttgctaggattaataaaatcatcataaatttgatatagattgtattttcatttgaaaaaccgcagaaaagcggtttttcctatttattctgattatttagtgataaaattgcctggattttaatctttgttatgtgtttgagtggtgagtgaaggaaatgttatgaagaaagtgcgtagatattcggaagcggctttcgtatcactattggtaacagcttgtggtgggggagataattcctcaaatatgacacttattattagacaataactatttgctagcacagcttggaatggcaaatgcgaaaaacaagattaagcgttcaattttaatgccaaatgaaacacgccgtgtcgaaacagaggttaaatcaaagctttatcatttctatacggaattaggacatcgtattaaatttgaacaaggtgaaataagtccgtttatcggataccaatttgattctgtttatcaaaaagcctttgacgaaggaaaaaactttggtattcaagcgaatcgtactcaatataacttaaatagttatttgctagggttaagtgccaccatgaaatggggagatttgagcttaaatacgaccttatctcaccgtatgaccccaaaagcagaaaatgcgtttggctttaatgctcgctatatcggtgcggaaagtgaaattgaattacagggtatttcacctgcaaaatatgccactatggcgaagttgggattgaattatcaaattagcaaagctcttcatcttttcggggaatatgcgattgctcgtcaaaaaggtggagaaaaatggcaaaacgtgagtgtaggaatgaagtatcagttttagtcactttttgcaaaaaatcaggctaaagtgaccgcttgtatatcatttgcttgtgaaataagcctttttggactattatcacaggcgattacattgctgttaaaagcaatgagacagacaatttaggggcgtatcttacgccccattatttatttaagagaaaaaacaatggcaagagagttttcaagagcagatcgtgtagcacaagagctacaaaaagagattgcaattattttacaacgtgaggtgaaagatccgcgtattggtatggtgacggtgtctgatgtggaaatcagtcgtgatttagcctatgccaaagtgtttgtgactttcttgtttgatagtgatgaaagtgtggtagaacgtgggttagaggggctaaataaggcttcgggctgtattcgtaccttagtgggtaaggcgatgcgtttgcgtatcgtgcctgaattgcgttttgtgtacgatcagtcgttggtcgagggtatgcgtatgtcaaacttggtgacaaatgtgatccgtaaagaccaagagcgtcacgttgaagaagagtaacgatgagcagaccaaagaaaaaagggcgtgatgtccacggggtgtttttgttggataagtcgcagggcgtaagctctaacgatattatgcaaaaggtaaaacgcctgtttaatgcgaataaagcagggcatacgggagcgttagatccgcttgctacgggtatgttgccgatctgtttaggtgaggcgactaagttttctcagtttttgttagaggcggataagcgttatcgggtgatcgcaaaattgggggagcggacggatacttctgatgctgatgggcaagtggtgcagacgcgtgaagtgaaggtcgaaattgcagatattttggcggcacttgaggcatttcgtggtgaaattttgcaagtgccaacgatgttttctgccttaaagcataatagtaaacccctttatgaatatgcgagagcaggcattactgtggagcgtgaggctcgcccgattacgatttttgagctgttatttgttgagtatcaagccccttatttgacgttggaagtacattgttctaagggaacttatattcggacgttggttgatgatttgggggaggcgttgggttgtggcgctcacgttacaatgttgcgtcgtttggcagtcgctgattatcctgttgagaagatgatgagcttagaagccttgcaaaatttagcggaaaatcagccgcttgttgagttagatcagttgttgttgccgatggatagtgcggtggctcgtttgcctcatttggatttaactgatgaacagacaaaagcagtgggttttgggcaacgtgtgaaatttgataatccgcagggaatttatggacaagtacggttgttttcagcagaaaagctgtttttaggcgttgctgaaattactgcggataatgtgattagaccaagtagaatggtcaatagataaagtaagatgataaagagatcctatttaaccatatcaatggcgtgcttggtgttggcagggtgtgctaattctgagcaagagtatcctaaggtggcgttggaggctaagtatcctaatgctcgttctttagctcattttgatgattatgtgagttttttaaagaaaaaagcggcgaatgaaggggtttccgcagaggcgctaaatacggcgttgaatattcaatatgtgcctcgtgccgttgagttagatcagcaacaagctagtcgtcgacgtgatcctaatttacctccgccaccgccaaatccaaatggggtgacgaattatttgaataagaccttaacccaagcaaaagtggacgtggcggcacaacgttggtggcaatatcagcctcaattaaccaaagcaagccagaaatatggggtgcaaaaagagtatttgatggcgttatggggtatggaaagtagcttcgggcgttatcagggcaattttgatgtgttgtctgtgttggcgacactggcatttgatggtcgccgagagaagttgtttactcaagaatttgtcaatgcaatgaagatgttgcaacagggaaccttagtgcgtgccgagatgaaaggctcgtgggctggggcaatggggcagacgcagtttatgccaacctcttatttgaactatgcggcagatggcgataacgatgggcgtaaggatatttggaaaaatcagtatgatgcctttgcttctattgcgaattatctggcaactgttggctgggataaggacttgccgtggggggtagaggttaagttggctcaacctatcgatctctctttttctgggattgagttgaataaagcaaaaagccttgctgagtggcaggcgtggggtgtttatttagcctatccaacggctcaagaaacaacaaaactgaatgcgttgagttcagagaagttgtggttggttcgtcctgataaagaggtagggcgagcgttcttggtgtcgaataatttccgtacgattttagattggaataagtcgaataattttgcggtgagtatcgggaaatttgcagatcgtattttgcagagagtagagtagggaagaacgatggcgacctatatcgtgggagatttgcacggctgttttgatgaatttcagttgttgcttgagcaagctaattttgatccgcagtatgatgaactttggctaacgggtgatttggttgctcgtggcgagaactctttggcttgtttgcgttatgtgaaggctttgggggagagggcaactgtggtgttgggtaatcacgatgtgcatttactttcgacactgcagggaattaaagcggtgaagcctaaagataaggttgatgcgatttttgaggcggaagatcgtttggaattgcaaaattggttacgctctcgaccgcttgtggcacaacaccctgttcatcaatttttgttagtccacgcaggagtaagcccagaatgggatttagcgaccactttagcttgtgcaagggaagtggaagcggtgttacaaggtgagcaatttgcagattttcttgctcagatgtatggcaattcaccagaccagtggcgtgcggatttgcaaggcattgagcgttggcgttatgcattaaatgtgtttacgcgtatgcgtttttgttatgcggataagcggttggattttgattgtaaattaccagtcgaagaagccccagagggcttaaaaccttggtttgaactagatgatccgttttatcgccagcaaccgattatttttgggcattgggcgagtttaattggttatcaaactccagatacgatttatgcgttggatacaggctgtgtttggggtaatcatttgacgatgttacgttgggaagataaacatatttttacacaaaaacgcttaaatttggattaaaaacaagcggttggtttccctcgctattgcgttgtttttgctttttctttagaatagaccccgtttttatgcgactatagctcagttggttagagcaccaccttgacatggtgggggtcactggttcgagtccagctagtcgcaccattttccctaaagcagaaattccccgtttctgcttttattttataaattccccataaaaacaaatacttacctagtatttaatagttaattacccactaaaaaccacgttttctaccccctgtttttttataaaaaacagtcattttctgatcgatttcgatctgttctaaaattaattgcacacatttgcacacatcaactgcacacattgaaaataacgatgcgtgcttgatacacaagggatagaacaatggcaaccatcattaaaaacggcaaaaaatggcgagcgcaagtgcgcagacaaggtataaccaaaaccgcaacattcacaacacgcacagaagcggtcaattgggcgaattttatcgaagcagaaattgaagcagggcgttacacaaacaccccagatgtcacattttccgccttactaatgaaatatttacaagaagtgacctgccacaaacggggtaaacgtgaagaacgcttccgcattttacgcattgcctgcacatcgcttggcgaagtcaaattgaacgaacttgccaaagagcatttcagagcgtggcaaaatcaatggctcaccgaagtacaaccagcttcagtcgcaagggaaagagccaccctatcagccgtcatcgcaaaatttttgacaaccaaccctttaaaaaccttagaaaaaatcaaactcccagcagtgaccctatcccaaattctgtgtaaacacccatttcaacttaacggtgatcgtctagacgatcaccaaaatcaatcataaatcgattcatcgccagtttccagttctgactgacggtatgcaccttaccatcacgctttaaaagcccgaatacagcggttttacccacagctccacgacctcgtttacctttgcgagtgccgtcaaaatagctttcatcggcttcaatttcaccttcaaacatctccatatttgggctgttttgatagataagcaatcgcagacgatagaagtaataggctactgtcgttttatttacatttaccaactcagccgctgttcgagcagtgacacctgccacaaacagctcaatgagtttattttgtttatgctgacttagacgactttttctcatttggttattttaacctaaaatagagcttttagtcgttatctaggacagccccaagatattttacacacattatgctatctctctactaagagtataaataatgctaaagcgataatttagtaaattgattttttctaataaaaagtacctataatttgagatattactttttctcttttgatgaagagtcagtagtactgttttgagatagcatgttttttgtaaaagaaagtttactatttagaaatatttttctattccgtgtgattttttctagctaaattctgtattttaattaaaatatacatgttcatttttattgacaggtaattgtatgaaaaacaaaacattaggaagtaccttaattgttgcaggtacgacaatcggggctggaatgcttgctatgcctttgacatcggcaggtatcggctttggttttacatttttacttttggttgcactttggttgttactttgctttagtgccttattattcgttgaagtgtatcaaactgtggacagtgatgcagggcttggtactttggcagaaaaatattatggcactttcgggcgtgtagtttcaacaacggttttaattgtatttctttacgctattttatccgcttatgtatcaggcggtagttcacttcttgctgcatttttaccaactattattgatgctgaaaccactacgcgtatttcaggtgtgatttttacactcgtatttggtgtatttattattttaggtacgaccagtgttgatgcagtaaatcgtctattgtttaccactaagattcttgcttttatcttggtgttatttttactcttgccaaacgtatctatagataacttaatggcaatgcctattgataatgcgttattaatttcagcaagtccaattttctttacagcatttggtttccacggttcaattccaagtttgaacaaatatttagaaggcaatgtgaaagcgttgcgtatttctattgttgtgggtacatccattccgttagttgcctacattttatggcaattggcaacgcacggcgtattaactcaaacagaatttttacaaattttggaaaaagatccgacattaaacggtttggctgaagcggctagacaaattacaggcagttcaattattggtgcaatggtgcgaattttctcggcattagccttgatcacttcattcttaggtgtggcacttggtctatttgaagcattggaagatcttttaaaacgtgtaaatataaatgcaggaagagtgagtttaggtgcattaacctttattccgccaatgttatttgccttcttctatccacaaggctttattgcagctctaggctatgctgggcaaatgtttgctttctatgcgattgtgttaccaattgcaatggtttggagattacgtcgtcaaaatctaaatttaccatatcaagtaaaaggtggttctatttccctattactcgctttagttattggggtatttatcgtgatggtaccattcttgattgaaagtggatggctaccaaaagtggttggataatttgttgaatagcaagtacaaaaattaagtcattttgtattataaaaaaatacactgagtgtaataatttttttacattgagaatttttcgttacgttttaattttgttttgctagaatgcctaggatttttatttcaggagtttttatgaaaaataaaattttaggcagtgccttaatgattgcaggcacaaccattggtgcaggaatgttagcaatgccattaacttccgcaggaatgggctttggaatgacgttggtattgttggtgggattatggttgcttctcacttatactggattactgtttatggaagtctatcagaccgccgcacagcaagatgttggggtagcaacccttgctgaacagtattttggaatgcctggtcgcctattagcgacagtgtgcttacttgtactgctttatgcacttttagctgcctacattacaggcggtggctctcttgtttcaggactattacctgaaatgggagaaggcgataccaccttaaaagttggcattttgcttttcacctttattttaggggtatttgttgtcgtaggtattaaaggggtagacggtttaactcgtgttctttttatcggtaaaatcgttgcatttgtatttgtactgttaatgatgtttccaaaagcaaaattagagaacttaaccgcagtgccactagataacttattagttatttcagtgatcccgattttcttcacctcttacggcttccacgttattatgggtagtattaatagctaccttgatgcggatattcgtaaaattagaattgcggtgattatcggtacagtgatccctctcggtgcttatttactatggcagttagcaacacacggcgtattaagccaaggcgaatttgtcaccttattaaaccaagatccaactttaaatggtttagttaaagcaacaagccaaatcacaggcagtaccattttaggcgaggtagtacgtattttctcagcattagctttaatcacctctttcttaggggtagcaatgggtatttttgaaggggttggcgatttactaaaacgtgtaaacttgccagcaaatcgagcgattttgacacctttaacctttatccctccgcttgcatttgccttattctatccaaacggctttattgcagccttaggttatgcaggtttactctttgctttctacggattaattttacctatcggtttagcgtggaaagttcgccaagcacaccctaacttaccctaccgtgtagcaggtggttctatcggtttaattttggctttcattatgggtattgtgattattgttatcccatttctaatgcaaaacggtattttacctactgttgctggttagaggtatattgcttaggtttctattctgcaccttagttaattggtaaagccaaacctctttgaggtgcagatccatatcaggttcctttaattttgtctctatgcctttattggaatattcttagggtaaaaagacagcttcttatcgttttttatctaatttttctggttgctcaattaaaattagaatggcggagttaccaccccattctctcggtgcttggtgtaatgcaatcactttcggatgttgaacaagccaacgagggatttgatatttcaacgcccttgtgccatagcctgtcataatgctggcacaataaatcccttctcgctcacaagctaaaattaaacttgccagctcttttttggcattttctttggtcaaaccgtgtaaatctaaaaagagttcagggtgaaagtcgccacggcgaagctgttttaaaatataaggatcgacatcttctcgacggtatttcactttatcattttcttcggttaataacggctcatattcatcggaaaaataaaacaatgtatccgctttttcttttaattctctgatctcattgatttttttacgcggttcaactttaggaacaaaggtatcttgtttgattttctttgttcccttaatcgcttctcgaaacaaagctaactcatcattttctaacataatatttccttttaaattaatcagcccattctaacacaaagggaaatatggtataaaacggcaatttttcaaaataggtattaaatatgtacgaacataaccttgaacttcttgatgaaatcgcttcatcgcctgttgctgacgatcttgccactattttagatatgatgcgttgggcatacagctactttaacgcctctgatctctattacggacacggacacgacaatgcgtgggatgaagccaatcaactggttttaaccgctcttgcattgccaatggacgtgccagaaacactctacgcttcacgcttaacctgtgtagaaaaagaacgtattattgaaatggtcgagcaacgtttaggcttacgcaaacccgttgcttacttaacaaattcggcgtggttctctggcttagagttttacgttgatgaacgagtgatagtgccacgttcccctatcggcgaattaattcaacaaggttttacggggattttacgagctgaaccaaaacgcattttagatatgtgtacaggaagtggctgtattgcgattgcttgtgccgacaaattcccaaatgctgaaattgatgcggttgatctctctgtagatgcgttaaatgtggctgaaatcaacattgaacgacacaatatggctcatcgtgtattcccattccaatcagatctgttcaacgatctaccacaagatcgctatgatttaatcgtaactaatccgccttatgtcgatcaagaagacttagacgatatgccagaagaatttcaccacgagcccgaaatggcattaggttctggggcggacggcttggatattaccaaacgcattttagctcaagtggcagatttcttatccgataacggcgtattagtctgtgaagtgggtaacagtatggttcatttaattgaacaattcccaagcgtgccattccactggcttgaatttaaaaatggtgggttaggggtgtttagtttaacccgtgagcagttagtggcgaatagacatttattcttttaactcatcgggtttgttatatttcctgtattttagtacgtatataaagattaaattcagtaatttttagaaaattttcgttataatagaacccaatttttattaggaggaatatccatggctaccatcaaagatgttgctaaattggctggggtttcaaccactaccgtttctcacgttatcaataaaactcgctttgtggcagaagatactacaaaagccgtatgggatgcgattgccagcctaaattactcgcctagtgccgttgctcgaagcttaaaagtgaatacaacaaaatcaattggtatgattatcacaacaagcgaagccccgtactttgcggaaattgtgcttgccgttgaagaatactgctatcgtcaaggctattcgctatttttatgtaatacccaaaatgatgctgaaaaagtacaaaaccatttagatatgttaattaaaaaacgggttgatggcattttggtaatgtgttccgaatatacggaaaattccttggcgttatttaatggcacgaatgtacctatggtggttatggattggggtccgaatgatggtaagagtgaccgtattatagatcacagccttgatggtggttatatggcaaccaaacatttaattgataatggacattgtgatattgcgattattgcgggttatctttataaaacaaccgcaaaagcccgttatgatggttttgttaaggcaatgacggaagcaggtctgttgatccgcaaagagtggatttttgaaaatgactttcagcctgagggcggttatgaaagtatgaataatttgctcaaacaggataagttacccaccgctgtgatctgtggttgtgatgcaatggcgttaggtgtgatttcagccattacagaaaaagggctttctgttccgcaggatatttccgtgattggctatgataatatccatagttcacgtttctatgcaccgcctttgacaactattcatcaatctaaaacacgtttagggcaaatggcaattgataccttattagagcgtattcaacagcataatgagcaaccgtctgagcctgttactcctaaagtattggaattttatccagaattagtggtgcgtagttcggttcgcaacctaaatcaataaggacgttagaatggaactattaattgagtttttcagcagctatggttattgggcggtatttctagtattgctcgcctgtggctttggtttgcctattcctgaagatgtcacattagtgtctggtggggtaatttctggtttaggatacacgaatgttcattggatgttgtttgtcagtatgctgggcgtattagtgggcgacagcacaatgtactggctaggtcgtatttacggcgagaagattttgcaattccctcttattcgccgcattgcaaccccagaacgcttcgcaacagtacaagaacgctttgaaaaacaaggctggaagttgctttttgtggcacgttttttacctggtcttcgtgctgtggtgtatctggtttctggtattacacgccgagtgacctttactcgctttgtgttagtggatttctttgcagcaattatttccgtacccatttggatctatttaggggattttggcgcaaaaaacctagactggctacatcaacaaattcaaaaaggacagatggcaatttggcttatgttattgattggcggagccattgtattttggaaatggaaaaagtctcataaagtaaattgaaaaacataaaaaaagcccctataacaggggctactcggaaagcaaatttatgatttgggttattggacataacacttatttttgttgctgtaagattacgtcaattttttgagtttttcaaattttatttgcataaaaacataatttttttatttttttgataaaaatcaaattttatgttcctaatttagtagccaagctctgccataatgtttcatatgacctgctttttgtcctgcttgatgtccaattccttgataaaggtcgaaatgttgtcccttcactgcgcccccaacatctaatgctaccattaggcggaattcatggtgaccattccagttaccattgtgatcaagtataggcatctcaattaataatacacttcctgttggaatgaggcgcttatctgatgcaactgatgctaaaggaactaatgggactcttgctgatccttttacttctagtgttggatctcggcggaagtacacaaaagaattatttctttccagtagtgactgcaatctgtgaggattttctttactccatttacgaattgcttgaatagagatattctctttcgctatttctccatcttctactaacaaacgaccgatactggtgtaagcatagccatttttatctccgtaggctaaatgatgtagcctaccaccaccgatatcaacaaagccactaccttgtacttccatcaaaaagttttccagcattgaattagtataagccaattctaaacctttgccagccagcgcaccgcggtaaatttgagcccttgagtatttcttattccctttaggaattgcataaagaggatgatgaaattcaccttctggacgtattcttgctgggattacagggatataatagcccgtcattagtacattttggtacccatcctgccctcgcatttgttgaatttggactccgtaatgttttaaatctttaatttttcctccatgggataaccaagtaaagagcttattatatgtttttacatgatgcttcattaggttagttgaatggttttgaatatgagcaagttgttgtaaaaaatccttttgattaacaatgttattatttatctgaatatccgatatattcactaatggtacattagatggaataaatttacgttggtaaaatttagctcctaattttgttatttctgtattaggctgctcagatatttttgtagaacaagcagtaaataatgttagggtgctaagtaaaattatttttgaataagttttataaaacatatttgttcccttaaaaatatacatcaggtaaaattttttcttacctgatgttcataaaagtgtcataaaggacagaggagataatcatggaaatagttttgaatcttatttagattaaaacgtcacccacaaccgatcttgtttctacacgaacctctttgagcttcactttcaccgcttgcccgagctggtaagccttctcgcctttgatgtagagtgcaatctcttctgggctaaataacatttcttctttgttattatacagagttgagaatggaacaaaaatcgaagcgccattttcaatgactttaacacgtaagccaccacgagaaacatcttggatttcgccgtcaaattctacgttttgttccaccataggctcaagataacgagcataaagccagtcggcaatatcacgttcaaccatacgattttgcttacgagcttcttgtaagcgagttaaaacggtttcttcgacaggttttgctgtttgatttgcaagaacttgtttaattaaacgatgattgaccatatcgccatatttacgaattggcgatgtccaagttgcataatggctgatacctaaacctaaatgcggagctgatgttgctttaaattcagcaaaagttaaatagcgacgtaaccgcatttctaagaaattttcagggaattgctcaatatcacgacgcatttcgcaatagccttcaagggtacttaaacgctcaggggagtagcgttcagataaactctctcgattttcatcattggaaagtgtatccagtaagaatttgcgagcaggctctaggtttttgctatcaaaacctgagtgggtattaaatacacctgtgtgtgcatatttatctaaaaactgtgcggcacagatgttggcaataatcattgcctcttcgatcatttggttagcgatacggcgatagtcaatgtgaattgctttgactgcgccgtcctcggctaactcaaagctgtaatcgcctagctctttaaatagcagtgcatttttgctacgccagtcgatacgagcaagggtaaattggtgcaaccagtcgatttgctgtgcggtttctgcatagtctggtgtccagtgattttcgactttttcaagataatcagacacttcgtcatagaccaaacgagctttagattgaacccaagctgacacaaagcgagcttcacctaccacattaccgcttaaatctgtctcaatatagccgactaatgctgggcgtttttcattcggcacgagagagcaaagatcatcggacagctctcgtggcaacatcggaatgttaaaaccaggaagatagttggtgaaacagcgttggcgagcggctttttcaattgcagactgctcaggaatgtaagcggtcggatcggcaatcgcaaccactaaacgccagcctgtttgcgtgctgttctcgctaattggttcaacgtataacgcatcgtccatatctttagtgctggcactgtcaatggtagtaaaatagagatgagttagatcttctcgctcgacttgatcctgtagctcatagcttttctcattcgcaacgggttcacgaggctgttcgtggcgagctaaagttacccaccacggcgcgaaattatcgtccgctttacagataaattgcgtgacttgagcaaagaaaaagcgatcatcacgaagagggtgtgttttcaactgtgccaccacccagtcgccattttcaagggggtctgtgacttttttctgcgtattggctggaataaagttattgatacttgggtgatcaacggctaattgcaatttcccgtctttgttaaaacgcacttgagcgataaaacgttctaacattggctctaataacgagtcaatctcaacttgctctttatcgccatcacgcttcacaacagctttgaccttatcgccgtgcatcacttttttcatttccgcagggggaatgaaatagctatttttctcacattctaaaaagccataacttttatctgacgtttttacaacgccttcaacatattctttacttgcttcaatctgttgttttaattgagctaatagggggttattttggaacatagattctcgagttgataaaaataaaaagcggtgcgaaatgcaccggtataactgagaaattatagcggatttcaatcgagctgtctgagaaatttatgattatttcgatcgctatcgaaaaaatagcaaagcaagctagccaaaatatttttataccttaggctataaaatagctgaaaagttgtactgtgtacgttatactaaggttgtttgaatggaaacagaagaatatattacttttattgaaaccaaagtctttgaagaagatcgaaaagcattaatgtctgatgatgaatatcagaaatttcaggcttatttattagaatctcacgaattaggcgattttattcagaatactggtggttgccaaaaaattcgctggaaactagaaagtaataacaagggcaaaagtggtggtgtaagggtgatttactatgttgtaaccaaacagggaaaattattattaatgatgatgtatgctaaaagcaaacaagacaatatgagtgataaacaaaaagcaatgttaaaagcggttgtatcccaattaagtgaggagtaaagatggaaaaagaactttttgaacgtctaatggaaagtgcgagagaaatggtcgccattgaaaaaggcgaaatagaagtaccaccgcatcgtattcatatccataaaatcccgaatgtcaaagcgattagaacccagcaccagatgaaacaagcggaatttgcttcccttttaggtgtaagccaaaatcttgtgcagtcgtgggaaatcggcagacgaaccccaaatggtgcggcacggaaattgcttgcgattattgagcaacagcctaatcttgttccagtacttcagaatttgtagtactttgtaagcagtgatagtgagtaatttttgtaatatcccctagaaatattgatattcctagggggctattaaaagataattaaattaacagagaaactgattgttatataagttttttatttttaagtgttatttacagtctgattttctgtaatttctcctgctttggctaaatccgctgttgaaatattgaaaatatccgcaatcatcttcactagacgaacatttagtgttttttttccactttcataaagtatgtattctgctgttgaaatatttaattcttgagccatcatagcttgagtgaagtgatgttgttctcgtagtttttttatacctttaaggatacgttgttcaagttctgcttcttctttagaacgtattggcatttcttcattttctttaacttttgattcatttgatttcgcattttcagtttgcagtctttcttctatttcctgtctattatctgtaagctttcttaaataagcgatttgaataacggcaggaatagttactcgaaaagctggaccagcaatatcgacagctatcgctagaatattgattgttatgccaataggtccagttaaagcacttaatattttcatcatacctgagttagctacaaatgttagtcccttgcctgttaacgccttcataactgcattagcaattattgctgtcaattggtaagacttaaaacttccagctttgaaaagtgcttgaaatgctgccattttcaatttcccaccaacaacaaactcagctttatcaatgcccagttctattgataggtttgttaattcttgatcgctaagtttctcgagagatgtttgtaagattttcattaagagtgcattttcaatatctcgagtcgattctgtttttttatattttactttcaatttcttacaaacatcacaaagtatttccttataaactacaccatgccctttaactaaattagtaaaggtattaccgccaaagtattgaatttcttcagcgatttcatcccaatatgcattatgttgtgggaaataacgcttatatttatctgttgttgtaagggtttctgtaagacgaggagagccatctttatcgtgagtaagtacataaactaaatcatctagttcatttgaacgacaatcttttaaaaattccaaatcataatcgtgaaggtaagccatataaaactccatagttgaaattaaataaaaaagcacgtttaaaacgtaggcatatagtagcttttcggttatactcaaaccagtaacgacttgttatagtggtttacccaaatatttattatttacctacccaaaaagagttttttatgaaatttactgagcaaattcgacataacattcgtaatcttcgtgaagaaagacaattgacccaagctatgatggcagaacgattaaatttgtctgaaacagggtatgccaaaattgaacgtggggaaacgcaagtcagtttagatcgtctaccacaaattgctgaagtattaaatgttgaatggtgggaattatttcgttctgatgaagcgggaattaatatcggtaattatagccattcaagtaatatatctctcgcttttggtagtaacagtgttgtattagaagccgaaattaaaactttaaaaactgctcttgaagcaaaaaatgaaattctcaatagccgtgagcgagaaattaaatctcttgaatctcgtattgaatccttagaaaaaatgattgagattttggaaaataaataaattgtatagatatattgtatagtttgtaataatagagaatagattaaatattcttcaaacttttataagaaaggacaggcatgagcctgtccctataaatcacttcaataaagcaattactcttcacctaattcgcccattgcagtaatgctaaagcctgcatcaacgtgtaacacttcacctgttacgcctgaagcaaggtcagaacataagaatgctgctgaattacccacatcttcaatcgttacggtacggcgtaatgcagcggtttgttcgaatgctgcaagcattttcttgaagtttttgatacctgatgcagcaagcgtacggattggacctgctgagatcgcattcacacggatgccttctttacctaaatccgctgccattacgcgagttgcggcttcaagtgatgcttttgccaaacacatcacgttatagttagggattgcacgttctgcacctaagtaagaaagggttaataatgctgcgtctttgtttaagaatggacgtgctgcttgtgccattgccacaaagctgtatgcactgatgtcgtgggcgatgcgatagccttcacgagttgcggcatttacatagtcgccatctaattgatcacctggtgcgaaggcgattgcgtgaacgaaaccgtcaaatttttcccattttttgcttaattctgcaaagcagtttgtgatgctttcatcggttgctacatctaatggtaatacgatgtctgaaccaaactctttggcaaactcttcaacgcgtggttgaagtttgtcgtttaaataggtaaaggctaattctgccccctgtgctttcattgcttttgcaataccgtaagcaatcgaacggttgcttgctaaacctgttactaaaatacgttttccagctaaaaagcccataaatctgtcctctgtttaaataaaaagatgccaaattggcaaaaattgtggcgattataacgaaaaattagggtgtcgagcaaatataagcggtcagatccgagctgttttttgcaaattcaatcattttgccacaaaattttaacttttcccttgaaatcagccatttcacccttattatagagagcaattttttatagatttatatttcaatgtagggatacactgcgtgtgtccgtttgaatttaatatagtagacacacgcagtgtgttcctacatttgttatttaatttggataatcagagtagagaatgggtagaaaacgcagtgcaagttcatctcgttggcttgcagaacatttcaaagatcaattcgttcaaaaggcacacaagcaaaaacttcgttctcgtgcctattttaagttagatgaaattcaacaaactgaccgcttgtttaaacacggtatgactgtagtggatttgggggctgctccaggggggtggtctcaatacgttgtcacgaaaattggtgataaagggcgtgtgatagcttgtgatattttggatatgaacccgattgtcggggtcgattttttgcagggcgatttctgtgaggaaagcgttttaaatgcgttgttagagagagtaggggagggaaaagttgatgtggtgatgtcagatatggctccaaactttagcggtatgtcttctgtggatattcctcgtgcgatgtatttggtggaattagcgttagatatgtgccgtcaagtgttagcaccaaaaggcagttttgttgtcaaagttttccaaggggaagggtttgatgattatttgcgtgaaattcgttcattatttaacgtagtaaaagtgcgtaaacctgaggcttctcgtgatcgttctcgtgaagtttatattgtggcgactggttataaaggataatgtagcttatcctgtaaaattatagtaatcttaacaagtttttgattaaaaaggggtacaaaccttgaacgatatgtttaaaaatattttgctttgggcggtaattggtattacgttgatgacggctttccaaggctttgaaagcaattttaatagtgcgaatacggtggaatattcgacttttattgacgatctgaaacaaaatcgcctcagagaagtgaattttaagagtaacgatgaaacgattactgtggcaaaggttgatggttcagaatatcaaacggtaatgccgatgtatgaccgtgatttgttaaatgatctcttaaataaaaatgtcaaggtgattggtgaacctgcagaacgtcgtggattgttatcgcaaattttgatttcttggtttccgatgattatgctcattggcttctgggtgttctatatgcgtcagatgcaaggcggtggcggtcgtggtgcgatgggctttggtaagagcaaggcaaaaatgattgcccctgatcaaatcaaaacacgtcttactgatgtggcaggttgtgatgaagcaaaagaggaagttgctgaagttgtggacttcttgcgtgatccaacaaaattccagaaattaggtggacgtattccaaaagggattttgatggttgggcctccaggtacgggtaaaaccttattagcaaaagcgattgcaggggaagcgaatgtaccgttctttacaatggctggttcagatttcgttgaaatgtttgtgggggtaggtgcttctcgtgtgcgtgatttattcgatcaggcgaagaaaaatgcgccttgtattatctttattgatgagattgatgcggtaggtcgtaagcgtggcggtgcaggttttagtggtggtcacgatgagcgtgaacagaccttaaaccaaatgcttgtggaaatggacggttttgaaggtagtgaaggtatcattattatcgctgcgactaaccgtgcagatgtgcttgataacgcattaactcgtccaggtcgtttcgaccgccaagtgacagtggatctgccgaatgtgaaagggcgtgagcagattttgaaagtgcatatgaaaaaagtaccgcttgcaccagatgtagatccgatggttgttgctcgtggtactccaggttattcaggtgctcaacttgctaatcttgtaaatgaagctgcgttatttgcagctcgtcaaaataaacgtgttgtaacgatggacgattttgagaaagctcgagataaaatcaatatggggccagaacgtcgttcaaatacaatgacggaaaaagagattatcaatacggcttatcacgaagcaggacacgttattgttggttatttaatgccagaacacgatccgctgaataaagtgactattgtacctcgtgggcaagcattaggttttgcgcagtttttacctgagggggatcgtgttagtgaaacctttacgaaattagaaagccaactttctaccttatttgcagggcgtatcgctgagggtattatttttggtgaagataaaattaccacaggagcttcatcagatattcaccgtgcgacacaaattgcaagagcaatggtaacgcaatggggcttttcaaaagagctaggaccattgttctatcaaaatgaagatggaatgggggcaattaagggcgtttccgaagcgtcgcaaaaattgattgaccaagagatgcgtaaaatcattgatcgtaattatgagcgagcgaaacagacattattggataatatcgacatcttacacgcaatgaaagatgcgttattaaaatatgaaacgcttgatcgcaaacagattgatgatttaatgaaccgcagacctgttggtgaaccatcaggctggagtaattcggggaacgatgatgaagataaagcatcaacggttcaagatgataaacctgaagaaaaatctgtggataatcaggatttaggcgatgcagttgcaagccgagaagcagaaggcaaactgtagttttctaataaaggcagagggtatcttctgcctttattattctcaaattgtattatctttcggcatagtagacaaaatagttgctggttcagtaaaaactatgccccttaaaaaagcccttgtggttcgccgtcgtcagcttgtcgatatgcgagtagcagagctaaatcgtttgcaacaaagccacgaaacccagttggatgttgaataacttttttgtgtgtgaacacagttgctacgaaaacatttggcataatagaccaaaatgttggtgataattaaaggaaataattaaaaccagcacttttgtctactatgctaatattttaaattatccgttcatcaatacttccaactgctcttgaacttccagccattccatttcaacttcttccaactgttttttggttgccactcgctttgccaaagtgtctgtcaatttggctttattttccacgtcgtaaatttcgggggaagccagcgtttcttctagggttgttaaactagcggtgagcttctctaactctttttccaactgcgtcagctttttacgcagtggggcggcttgttggcgtaattcggcttcttggcgtttttgctctttgcggtttaccgcactgttttcattgtgacaagcggtcggattgtctgctttttttgcaaattccaactgagcatttagctcatttagccatttttgatagtcttctaaattgccgttaaattcttccactttgccgtcgtgaactaagtaaaattcattgacggtactgcgtaataaatgacggtcgtgggagacgatcaccaacgatccttcatattgtgtcagcgcttctgttaaggcttgacgcatatcgagatctaggtggttggtcggttcgtcgagtagcagtaagttcgggcgttgccatacgataagcgcaagcacaaggcgagctttttcaccgccagagaaagaattgaccgcttgtttgactttatcgccgtgaaacgcaaaaccgcccaaatagttgcgtagttcctgttcggttttttcaggggcaaggcgagctaaatgccacaaggcactttcatctgctcttaaggtgtctaattgatgttgagcgaagtaaccaagttgaacgccttttgctagttgtgtatgtcctgattgtgcttgaatttcgcctgcaagtagcttaattaaggtggatttccctgcaccgtttcgtcctaataaaccaatgcgagaacctggtacaagattaagtttgaccgattgcaacacggttctttctccatagcctgcactgactttttccattattaacaaagggttaggcagtgaaagtggttctctaaactcaaaggaaaacgggctgtcggcataagctggggcaatcagttccattttttcaagggctttgacacgactttgagcctgttttgctttggtggctttggctttaaagcggtcgataaatttttgtaaatgggcgattttttgttgctgttgctggtaagctgcattttgttgagcgagtttcgtcgctcgttggatttcaaacgcactgtaattacctgtgtaatcaaacaatttttgctgttcaatatgcagaactcggtcgataatcggatcgagaaaatctcggtcgtgggaaatgagcaataaggtgccatgatagttgcttaaccagcgttcaagccagatcacagcatctaaatctaagtggttggttggctcgtcaagtagcaacaaatcggaacgacaaattaaagcttgagccaaatttaaccgcattcgccaaccacctgaaaaggattttactggcagttgaagctgttcggtactaaaacctaagccattaagtagagttgaagctctagattgaattgtccaagcgtcaatggtatccagttgggcgtgtaaggtggcaatcaaattgccgttattctcaaggttggcttgctcaagttgggcagtgagttgggtatattcccgatcaccttggattacataatccaacgcagagatatctaatgcgggtgtttcttggtttacccacgcaatcgaccagtttttcggatagctggcatcaccgccctctgcttgtagttcattttttaataaggcaaacagtgacgatttaccacagccgtttttgccgattaagccgactttctgccctgtatgaatagttgcatttgcttgttcaagtaagatggtttgaccacgttttaaggttaaatctgtaaaaaaaatcattgaaaattaaataagttgtttggttttagggtaaatttattgcacaataacgaagattttgttttatgaggaaaagtaaatgtttgattcgttagttgtccaattcgttgttctttgggcggtcatcgaccctattggctccattccagtttatttggcaaaaaccgttggtttatcaccagaagatcgccgtaagattgcccgtaatgcgattttaattgcagcagggattttactctttttcttggtgttaggacaatggctacttgatgcaatgcaaattccattatcggcattccaaattgctggaggcttggtattattgctttttgcattaacaatgatttttggtgaaagtaagccagatcaagagatcaaaatgaaaagtaatctacacgaattagcggtatatccgttggcagtgccgtcaattgcatcaccaggggcaatgatggcggtggtgttattgaccgataaccatcgctacagttttggtgatcaggtgattaccacggggattatgttatctgtactgttaattacctatattctctttttagtggcaaaccgtattcaacattttatcggacacgcaggggcggcgattattagtcgtgtaatgggtttaattctttctgcggttgctattaataatattttgctcgggttgaaagattttattacacaggcgcagatggggtgatgtattacttacaacaaaattatgtcataaatagatgtagggacacactgcgtgtgtccatttaaaaaagactgcccctcacaatttggcggacacacgcagtgtgtccctactacttatattaaggaacacccaatgtctttacttccactttctcaagcactcgatacgatgctaaaccaactaccacgtccaacatcacaagagattattccgcttgatcaagcggtaaaccgaatttgtgccgaggatattttctcaccgattaacgtgccgaattttgataactctgcaatggacggctatgcggtacgaatggcagatctagaacattccactacgctacaaatcgcaggtaaagcctttgcaggtaatccgtttctggctgaaatgccacaaggaagctgtgtacgaattatgacgggggcaaaagtgccagtggaagctgatgccgtagtgatgcaggaagatacgacgctgaatgccaatggtactgtcaccattaatcgcttaccgaagaaattgggggataatatccgtcgtattggtgaagatatgaagcaaggggaattggttctcgctaaaggtagcctattaaatgtagcaagcctaccactattggcttcgctagggattgataaagttgccgtttatccacgtttgaaagtcgctattctttcaacaggtgatgaattagtgtctgttggaaatccattacaagaaggacagatttacgacaccaaccgttttaccgtccgccttttactggaaaaaatgcattgtgaaattgtcgattacggcattttgcctgatgatcctagtctgtttgaaaagacctttaccgaagtacaacaaaacaccgatgtgttaatcacaagtggtggtgtgtccgttggcgaggcggatttcactaaagatgtcttggaaaaactggggcaaatcggcttttggaaaattgcgatgaaaccgggtaaaccttttgcatttggtaaattggaaaaagcgtggttctttggtttaccgggtaatcctgtgtctgctttagtcactttctatcaacttgttcagcctgcattattgaaactagcgggcagatccgatgaacatattgcaaatttttctcctaatctaaccgcttgtaccgcagttccactcaagaaagctgttggtcgccaagatttccaacggggctttttctatgcgaatgaaaatgggcaacttgaagtaaaaaccgttggaacacaaggctcgcatatttttagtgcgtttaatgaaagcaactgttttattgtgctcgagcaagaacgtggcaatgttgccgtaggtgagcaagtgactattcagccgtttaaccatttattgagataaacacaatcaatgccctttttttcatcaattaaatttgttttataaaataaatatttgacacttatttagaaataggtaaaatgcacaccgttttcaagaacaattcaaatgcgggaatagctcagttggtagagcacgaccttgccaaggtcggggtcgcgagttcgagcctcgtttcccgctccaatatattttcttagggcgtgttagcaaagcggttatgcactggattgcaaatccatgtagatcggttcgattccggtacacgcctccacaccccaagccccataatatcatccccgatcattttctagcaaaatcaatatgttacagtattttcacacctgtataaaagatcacgctagatcagactaaaacggctctaaggcagtagaaatagcagtatattttaggctattgatacgcctcattttaggtgattaatatggcaattttaataaaacctctatcaaacttagacatcaaaaatgccaccgaaggcgaactactacgagatggcgaaggtttaattttacaagtaacaaagaaaaataaagtttggcgtcttgattataaaaagcctataaccaaagcgagaacatccatcacgttaggctattacccgactctctcgcttagacaggcaagggaaaagaaaaatgaactcaaagaactcatcagacaaggtattgacccacaagaacacaaacgcaaaattgagcgaaaaatactagataatctagaaaaaacgttttacaaagtagcgttacaatggaaagtatttaaatcttctaaagtaacgaaagaaacaatggaagaagattggcgacgtttagaattacacattttcccaactcttgccgacattcaagttgaacgtattacttcaaagttattagttgataccttacaaattgtctatcgtaaaggtcatacctctgtcattgaaaaagtactgcgtagcgttgaaggcataatggaccacgccgaaaattgcggacttatcgaaatgcacaactgccacaaagcaaaaaaagcatttcattacaagcctgcagaaaacaatcctacaatacctattgaagaacttccaaccttcattaccaagatgatgtttgccaatattgagccatatacccaacatctgattttctggaacctgcttactggtgttcgcccatctgaagccgttgcagtagaatggcgagaaatagattgggaaaaccgactttggcgaatccccaaagaaaaaatgaaaggatcacgctacaaaaaacgagagcatatcgtgccactctccaagcaatcacttgacatactgcaaagaatgaaagcattcagccgacattcccgttttgtcttcccacattttaagggaggcgaccgcccaatgtgtagcgaaacagttaatcgagcaatgaaaaggaacggctataaaggtattttcacctcacacggaatgcgtgctttaatcagcacacatcttaatgaacagaattttaatcccgatgctatagaaatggtacttgctcataaaattaaaggatcctcagtaagacgagtttataatcgtcacgactatctcaaggaacgaatagaaataatggactactggggaaattatcttgaacaacaaggcttacgttggaagccacttgtctaaaaacaaagccccacatcataataatgtggggccttttttagcgttcatctatcagcttttgcatataagctcgaatttccggccgaacataaaaggaaaaattcccaattttaattttctttggaaagtctggaatataatactccgaatctttccgttgccaacggtcaaatgtagctcgagatactccaaataatctcactgcttcgcctaacctaataaattcaatatcaggctcattttttgttactaaattctgctcattactgaccgcttgtacaatttcttgctccatcatctacctccgttaaattcccccctaacaccgcatagcccgcaatatctctccagttatcttcataacttggattattacccgttgaaatacgggctaatttcgtgcagatcatctctaacgcctcacgctgacggggcgtataaaaatcatcaggcacatcatcaaataacaaccctttcatcttttgggctgtaattgccgtatctgtaaaatccccgtactgctcgccacgttgggcgatggtttgttggatatttgtcatttgtactctctccaaatcctaatcttggggaatatctttcattctttcccattcaaaagaatttttcccatacaaactttcatcatagttttttgcccaaatagaaccgtcatcacataatacaatgattttttctatttcatactcaacatcatcaatctcctttattgcacactttgcaactgaaacaaaaattggttttcttttcatattaacctctaattaaaataccgtttttcttcaataagctgtcctcggctatatctcacatagatgccgatttgctcattactgtaaattttcagcggtttaccgtttaataaatcatcaatttgataatcggttacccgccctcgcattgtgattagctcattttttatcctttctcttacctcctgactaacctgattattttttaaccccgtacagttactgacacaagtccaagggcgagcaagctcgcctatttttgcctcgctatgctcggcttgttcgtggtagcctaataatttctgttgtctcatttcctcccaatttgtcggctttctaccaattttccattcttttttacgagtaatagccacagtaccgtttaactggttagcaacaccatttactttcttacggtcttgttgatatttatcttgcccatacaaagcgtagtgcagacgtactttcaattctttacgcagtactaatgcaccaccttgaaattccgtatagacagcccaatcacccacatcggcgattgctcttaaggtatcaattacctcatcttcctgctgttcatcgcctagcttacgacattcacgccacaccccaacactcgccccaccgatctgctgaaactgacgaatacgccacacacttgcccacgcctctacacgttctgcagctaaatttactggcgtacctgtctcttcatctaataggtcactcattcccttgccgtcgatatttttagaaatatatttcgcaagataagaagctccagaccccttagaacgatctattttcttaaaagtacaacggcgtttcttcgcccccgcctcatcaccatcttcttctaaagcgtaatgccaaaagacacgtttcaagtcacgaacctgttcaggacgggtatgaaggattaaatgccagtgcggtgtggcatcgtggtgaggttcggcaacacggaaaccatagatctgaataccacgacgttttaattcggctcgaatttttgcccaaacactgcaaagatatttctgggtttgatggggagcagaaccattccactttggattaatacccccctcgtgtagcattgcgtgatattttgacggagcagtcaaggtcacaaaaacaccctcatcgccattcttctcagcaatttggtcaaaaccattcattctcgtcatcagctcaatacggcgttttttcggattactatttgacttgagccacgtttctaataactcaacttgttcttcatcattaagtaaattagtgataatagaatttttaataaactcaaaattcgcacggcgttgttgttgatgggcgtgcaagcgttcattactgacatatccaccagtattaatattcaccattccaaccgcaattgccaaatgctctttcatacgcacagctgcacgttttaacttattatgccaataattcggacacgccaatttcaacagccccgaaacgacttcatcattaccgattttaagttttttggctttcttggcataaggagcagggatctgatactgctcacaaatttccaccaattcaagatacaactctcgcaataacgcaagtgcagtttcaccattatttgcttgatgaacacactgatttccgaactcttgctgacgttctcccatagtgaacgcaagcgtatttgccaattgttcaagctgatctggacgctgataacaaagaggggtcaattgatgatggctaaagattgccttactattttttacacgttcagcaatatcaggcattactaccttatagcgtctaatttttcgttccacacgctcttgatactgctcatttgtttcctctttcggaatagctttccagtatttttcatcgttttctggcatatctatcccatcaagaaaacttaaatcttgataaggtaaatgccacaagctcagcacgtccgcatattgcgacatcaccattttcactcgaggtaagacctcagccattttctgtttgaaccattgacttgcatagttagaaccataggctttcaaacgtttttgatataacttgcctaaataatcgctcaactgacggggcaatttatcgaactgtgcttgacgttcataatgatgatcgggatcaagctcaaatagatcttgttgcaccatagacaagcggtgtaaatcgtgaggttttttacgaacaactgatgatgaagtaacagatgaataaggaaaatggacaaaggagggagcttgttcagcaacgacaataggcggaaaaatttccgcctgttcactgtctgataaaatccaattttccttattcatctactaacccttggtagcaaagagaaaaacctttctcaacttgttgcaataaaggacgatatttttcaggaacctcatcgcccttgtatcccgtgatatttctaataacagcaagtaggacaaaatcactatggatatatttccctaataaccgaccattgcgatacaaatcaaaggtacgactaatttgccgatattcgaggctatagcaccgcttaccataaatgaaacgagggtaaaaggtgcgatactgcccaacactaacagtcataacccgcattcaatgtgcagtattctttaatcgtatcagcgacagactgaatcgcattggaaacatctgccagcgtgccatcttcctcaccactaaaaatcgccaactgcaccaaaccttcagtaagctcagtggcattacgatataaatcgccaatttggctaatcttgccgtgttcggttaatctaaaaacacgatagccatttgttaccgtgtgctgaatttcgaattgctcactactattcaggctaaaaataattttgcggttcattgtttatctcctatctaatcgccatcgtaattttaatttttgggttattaacccgttgcatcgtggtttggcgtaacgccttaaagtcatcaagtaacgcatctaacacataggtcacgttatcggctttggcgataaaggcatcacctttccacaacacatattcggtttgctcgccttggctacgttgctcaatgcaatactgatctaatgtgatgattgatgttgccataactgttttctctcatttccagcccgatatcgaataatcttcgtaggttaccccacggtgtttgcctagcttgcttcgttgtcgcttgcccatattgcttgtacacctgccaatagattttttgtaaatcataaaattgttgctcgctattcataatttcccttccgttttgctgtttcgtggaactcataaaatttcaggttctgcccgaatttactgctaatctctcgcatttctcgcaaagcacaggcaatccacgcacgttccgcttgtttaaattcatcaagaggcttatttgcattgatttccacggattgcccttgctcttgtgcaagtaaatttgccatacctaataaacgtcttcgttgcagataatccagacttaaaaaagctctatcgacacggttcagctcaggtttctcagggcaaatttggctggctaatactcgaccagcaacaaactgatcgatcaacgcccaacccttcaaccctttagctttcaaattttgcacctgctttaccccttccgcttcttgagctttgagataagcctcccattctgaccgtgtcatcgttcacccctacggattacccttactacacaacaccccaagcaaccactgccacaaacgacaaacaaggcttttcggttttggataggcaacccattgcaactctttctctgcttgctcacgggctttcttctcagccaccaacgttgccacctttgtttctagcgccgtcaataaatcgtgggtattctctaaatccagcgtcaccacttcctgacgaccttccaaatgacgcgcacgtttttccaccaaaaacagatttaaccgacggcggtctttcatctgtctgttcatacgccagcgttgattacgtctaaattgtttactcattgttcaatctcctgttttcagggtgcaaaaaaccagccctttaataaaaaggcgattttttacacaatttaaagattaatatttgaaatcagatgaatgtgtatattctggtgcgaacatatcaacagtctgtctatcaagctgatttagcggtttagtcgctgactgccacccttcagcttcacggtattcaggctcataaaactcaacaatctcagtcattgctttgccataacaaccgcactgatgacacctaaaaatagtgacacaggtctgcaatgtcggattagtcgatgttctcacactaagagcagaaccgcatttaagacatttcgtgtttgttttcatctttcccctgcctttcggcgatatcctttcttccactgtttctgccgttccccaacggcccccacgttttcaactcagttttccccttgcacattccccaatatgcaagcggtttgtttttggttatattttgctgatatcacctacctttgtttataattcaatttccattcactcaaaaaaggaaatcagaatgaacccaacacaatttgaaaatatttcaatgcttaatccagagcgacaatttgcaaaagcgattgttgcacaacttaccaaagaccaacttaaaaccttaaaaagtcgcttgcagttcgacccacgcaaattaccgcttacctttcaagccttagaaacggctctacaaactacggacgaagcaacatttaacaccctacgcactcgctattttcagctgattgacgagtttcaaaaacttgtcgaaccatcacagattgacgctttgcaaggctacgcaacttacatctctcaattaattgagcagacggacgatgattttctccttgacgatttggaaacgctccacggttatttgctgaactttttcgaaagcgtaaatactcgctaaaactgccaatatccgcccattctgcaagccctgcacccacagggcatttaactttctcacacattcccttttctcctcgtgttaaacacattaattgctttcaaaatttgcctttgtttataatcccattaggtactttctcaatatcggataaaagggatttcccgtatagccttgcacattatcactaccaactggagccgtttgggctacttccgcctttttaaatttccgactgacatttaagcaaacctgatcggcaaaatcggcatttaagagttcttttgccatatcttctgcggtgtttaactcaccttcaaattggtctatttgaattaccgcaatgcgtttaccgtcttcatattcttctaaccaaaaacgggcttcaaatgttcgttttacatttaaagttttaatcattttccccacccttttttcaattgatctcaaaatttgcctttggaggatttttcgacatcgctaacgtcaatctctcaatctctttctgaacagctttcgcaaataaatgctcatcttgagaccctacctgaagatgcaacgctggaacgtgaatatgtaaatttactacaacagaaccagcagattttgcactctgcgataacgacggctcttgctcagcatttgaagccgtagtgtctaaactattcaatactttttccgcacactgcacgccgtgcattttggctaagtccaaaatgctacggctgaacattaaacaatctttctcacccatttccttttctcctcgtgttaaacacattaattgctttcaaaatttgcctttgtttataattccatttccattcactcaaaaaaggagtttaaatatgaaatcgaattttattgatcttgcaggttatttaactgctttccttatcatttggttatttaaccgctatatcctgacttctgatttaacattcctgttgcaaatgctcattttggttatcatcacaatcattttagaactcatctatcgcttagttcaaaaacatagtaattcagtaccattttcgccattgtggtattaccttgtttcgctttgtgtaatggcattggctctcgggagcttttcacaatctgaactgcaacaactcggctttaactttgcaactgatgaagcaagtgcaattcgacaatatctattagtaaaaagcctattttttgctatcggagcaacctcacttccacgattgcttagccccaaaataaacgctgaataatcatcatcacaatcgcaccgacaattccccaaacgataccaacccataatggttctgtaggtgcgagaataaggtaagataaaaagcaataaacccaaataaagcctttcgcccactcacccattccccttatcctcccttgcctttaaggcttctttcatcaaacagccaaccccaatccctgacggattaacatccgccccaatgctgccttagtggcgagccccaaacgttcacgctctttctcaaaggcaatgccttcttcctcgtttaacgtcatatgaaacgccacagacacttcacgcgtcgggcggatttttctcccagttttgtgactgagatcacctttttccatctagacaccccctgtgtttattgatattgttagctcattttattaaaacgatccattttgatcggtttcgttttgttgtgatgtattttatctcaacaaatgttgagattgcaagaggttttttataaatgaatgttgagttttttgaaaaaattaatgaaagacttaaaagtgaacgtcaaagattgctgatgacgcaagtagaaatggctgaaaaatgcggtgtaactccaactacatattcgaactatgaactaggaaaaagaaaacctgatgctaaatttttgcaagggtttgctgaaattggtggggatattggttttttattcacgggtagccataacaaagttcttttaaaagggtatgaagaagttgcgatggttgcgtttcattcattaacatcagaacaaaaagtagaagctattagttatatgactgctctagctcaaggtttgataaaaggtgggttcggagaactcttaaaaaattcaaatgggttaaacgaaattcatcaaactgctaacggtacaggcaataaccagcaagtgtttagtggcgatgttggggaagttatagggataaaaaaataggaaatgttatgaaaaaactactaatgctttcatttttaggcttaactctctcagcttgtgatgatacacctcaatcagcaagtactgaaacaaacgcaaatacatctcaacaaactgagtccataaaatctgaacccgacataaaggcaatattgcccgaaaatatgattaaagacgtgccattttctaaaaatgaaaaaggaacagttattttcaacaatgttttagatatgttttctgcgcttagcttatatgatgttgaagacaaaaatataaaactggtttctgaaaaaccattgcatatattactacatccaactattgcaaaatcagatgaagaaatcacattaaaagatagtcgatatgaatttctctctgcactttacagaatatttaccaacactttaactgatgaaattactttagaagtagtgcctattgatgttcaaacaaataagccacttcctaaaaaatatcacaccaaaattaaggcaacaagagaaaaagccctaaacgtattacagacttttagccctgcaaaagattttaatgatttagttagttttgataaacaaaatcaatatgtagtgctaggttattcttcatcgaacttatcaagtaaattttataatagcccttacgctacaaatattataaaagcactttcgactggaaaaattgaaattccaatgcaagatgtaattgatccgttaaactttaatttattgactattcaaaccaaattaagagaaattggaatgaatggcgactttgatattagaaaattagagtcaggcaaaaatgcttatacaattccattaaataaagttgtatctattgaagcagttggtaatgattgggaaaaaatagaaacggtatcacttcaatttggaatggtaaacgacaatgatattattctgcatactttagctggtcttgctacaacagtcttagtaatgccagaccctgataaagcctttaaagaaattaatgcaatgattgatattgcaggtaaaagaatgaaaaaagaagaaactatcaaagtgaagaaagttattgatggtattacattggagttaaaagtatttaaaaatatgggtggattaagttatctatcgtataaaaaaattaaacaagaacctgtaaattttaatgaataggagaaccaaaatgaaaaaattaagtggtggggattagaaaataatggcaacaccgcaactaaaacatcaacagattgcaacagaattaggtcagcaactggagcaatttctacaacagcccttaatgcccaccgcagagcaattaacacaggcagaagtagaagcacaaaagttaatttttcctgattatacccgttattatgcctatcaatgtctaggcttaattgaagcactacggggcaatgaacgtaaaaccattcaatatttcaaaaaggcaaaagaagcaaattcaagtgatacctctgtatctgcaacttatgctcaatcattgcgatatttaggcaaaatcaaagaaagtattaaacaacttgatttttatgtctcaaataaaacatgtgatattttttcgctgaatatggcactaaagttatgtataatttttggacaaaccacaaaggcggagctatttatgcaacaacttaaacaacttgatccaaaagcatttctttcttatcaccaaacagatattgagttcactcaattatggcaaaaaacagggatccccgaaaacgccatcttggattatttggaacacgcttatcaattcgccgcagagcgtaatatcaatttgcgtcaccctgaaattgtattggatgtcgaagatggcaattcattgatgtacatttttcgagataacgatttaaccacagatcaacgtattcaatatgaacaagaactcgacaaacatatgctttcatatatcaaatcccataaggattatccatttgaaaacattgtctttttcttaggtagatatagggatagtaaatgatttcagccaaagaccttgcacaaaaatcaacagaatttagctcgcttgacgaagagttttattggcgacaaagttcccaccttgcttattatgcggtctatcatcaacttgtcgcattttctttactacaacatattgatttaaaacaagggaatgggggtgttcaccaaagagcgattacggctatgaaacagcattcagagcaaggcgaagaattagccttttatttacaaaaaatgaaaaagcggagagttatcgcagattactacttagaaagtcatttttcaaaagaagaagccatattacaacaagcactaatgcaacaatgcttgacctacttaaaatagtcatacaaacaaggacagtatatgggcgatgttagtcatcaatattttaacggttctgtgggtgaaacaaacggcataaaaattgagaaacaaaccaaagtcgaaattcaccaacattttatttctcccttagacagaaaaaagctcactaaagagctaatggaattcaaatccaccgacccacaatttttcaaagcccttcaagacatttgcacacaaatgcgtggcgattttatgtttataaaattcaacgatgaagaatttcttaaattctacgaaattaaaaatatcctgttctccttttaccaagaaaaagaaaaccaccgtctttccctttctgaagaaaaatccaaagtcaccaaactagaaatggatttagccgtcgagaaaaatagagtggcgttatttcaacaagaaacaaaacagactaagagtaaaattggggaaatattgaaaagggtgtttgggtaatggatattgatcgcaagttgcaaaatggactattgaagctacttaaaattgcctatccacaaacattgtcagacgacgagctttattggttttatatagaagaacaattggataacgtgcaaacgtgggacgaaatgcaagactttattaaaaagccaaaagacggttttgctaacgcccacttaaaagcgaatttagcttatttagaagaacacgcccttattcgacggcttaatggagaatatcaagcgacagcaaagggcattgatttgattgcaaatgatggtggcttgtcggcaattttacaaatgcaaaaggttacgctagatgcggagagtttaaagccgttggtgcaagcattatctcaatcgcaaaaacagacaatgctagctcaggtacagtcaataccggttgagatgttaaaagagtggctgttggaagccctagtttgagacggtactcttgctcttcgtagtcttggcgtgtggcatatatcccatatgcaattggaaagtaagggctgttttcgtaaaaaaaacagccaacatctttgtttaattcaataatttgacttttaccaatgcgaataagtttaccgatgtaattcattattttctcccaaaatatcttttataaaacagtaggtgtgtcacggtctacaaaaataacgtcaggacgctttgtgagtatgccttcaaaaatatcggctttaagaataaaggggagccaaatacgatttaatgttgtttgtttttgcaacacatatttagggtttaggtttaagtgttcaattgtttttaattttgatgcaagttcaaatcgtaagtagatgtattgaccatcatccgtttgtaatccagtattatagtaacctacatttttatatgaaaaactatctacgtcagcattgagtgttattgctaccttgcctcgacgtttgctaaatgtaacatttaaaactggtgatttttccgatttttcgcacataaatttctcctttacgaatacggtgttaaaggtttttccgcagaatatcggaaagcacaatgaaataaaatgggcggtaggtgttatcaggctattcactaactacgaaaaaaatcgagtggcgttatttcagcaagaaacaaaacagactaagagtaaaattggggaaatattgaaaagggtgtttgggtaggggtaataatggaagaagttagaagtcttagtggaaaattgcttggctatactttaccaccagagtttgagaagctaaataaattaatcaagatgcaaaatcttggtggaaaaaccttaggttttttactcccccctgagtttaaaaaaataaaaggtttagttgaaattcaaaatctttctgggatcacaactggatatctattgccaccagaatttgaaaatttaaaacaggttcaaagtcaaattcctctgatttttaaatcggcaagcgatgaaaatctaaaagaaacaattgccaaaatccagtccgtcgtaaatttgatacaacaagaaaatggaatagatactcagggaatttctcaaaatttatctgaattatcagatgttctatcagaagagaaaccaatatcgttcgaacaaataaaaaaactaattacgttattatgggttgttctctttgggattatttctgcataccctgccataaaagaaatctataaagatgtcaccgatgatcctttttctgaaatttgtggggctttatctcaactagaaaaagaagcagccaaatttgtggaagtgaaccaccgtgctggtatcccaatttatttatatccgaaagggaataaatcagtagattttgtattaaataaaactcagctttgtatgatagttgagccaaaaggaaatcagaaacgagtaaaagtcatttataaactcgaaaataacaaacaaattacaggatatgctgacagaaacaaacttataaggctctataagaacgaataatttttgtataatgccaacatcaaggggggagttatgcaaaaagaattacgagtacaatttaatctattcaaaaaatggttgtttgtggctttatttttactcacaagcaaccctattttaaccgatataatcatctatattgcacccaataaagcggttaaatatacgatgttttttgtactcgcttcacttagttactatacattacaccaattattaaagagatatttgcttttatccaaacgcatagaacaataatattttactgcacatatcaaaccaccttcaactcacactcaatcgccgtagtaaatccgctatccgcagaaagcgaatgagtaacttgcgtcactatccacgcattcgagtcaatctcggctttaaagcccaccacgtttactgtagtttcggggattagctccgcattaccttccgcaaggtttaggctaaaggtcgccacgccacgttgtagtttttcaaagtggcgtttacaagcattcaatgcggtttgctgtgtagcgtaggtatgacgtagggttttaatttggtcattgtcgctttccactggcttattttgctgaataacggtggtctgctttttgctgattttgcctttcttggtggttttattgaccttcttcacttcggtattttcatcaataatcacttctccacgcttgcccgttgcggtgtcgtgccagtaggctttaaccgctttgtagttatccccttcagcaatggcaaagcggtgactgtcgccatcttgtcgggtgaggataaattcaggcagtttctgaccgcttgcagtggtggatttgcccgatttaataaacaataatcgcccatttttaacggtggctatcgcatcgtgttcttcggcaaggcgagttaaaaagctgattgagctttcgtccgtttggtcaatatgcttaatctcaaggtttttgtactcatcgcccaccatcgcttgtagttggttttcgtcggcaatctgttgcacgattttgcctagcgtggttttgtgaaaacttcgctcgtgtcggttcattaaactgccacgcaagtccgccgaccttgcccgaatggtgacacagtcgggagcgcctgaatgctctacttcgtccacggtgtattcacccttaaaggtcaaggcttcatctttccaacctagcccaagagataaaatcgctccacggctcggcagttccaacaagccgtcggtatcatctaaggtaaaatcgagctgatcggcttcaaagccccgactgtccgtcagggttaaattcatcaagcgttgagagagtagagtagtgatgtctttcgttccgcctgtggattttttcggatttggtcgaacggtaagatgaaaggcaggaatacggtgaccgttttgctttaatctatcaagtaaattcatagtaagctcataatgtcgtcgctgatttcggtcatcattgagtcatcgacccgttttagcgaaagggaaaaatcaaggcgacgtggcgcaccgtcaccaaagaaaaggctactttgcacgctgatattttcaatcacaaaccagcccaacaccataaacgttgccccatcaattaacggatagggtttgccttgctctgccattaattccaacgccgttaaacttaatcgaccgcctgtcagttcggggattaatgttccgctaatcgtcatcgtttcgctggctttgcctgtaaactgcgtgcgtggcaatttccccacgacactgtttgtcgggtggttccacgataattctcggctggtttcttggtagggtacggtttgtcgcataaaaacaaacaacccaaggcacatcatagcggagttttggagcatttaatttccttaatataacaagcggtcagatattgagatttttttgcaaatttttctcgttatccgaccgcttgtcttattcttcgttggtttctgtccgttttcgtgcttgctctcgccattgcattaattcatcaagatacatatcgtcaaaggcattgggttgccaatggaacacaatagcgatgtcagcaatggcatcttctacgcaataagggatgagtcggactttccctcttcgtcactttcgatgtcatcttcattcaagttcatcacttcaaagacagccccagtgagtttagtaaaatcagccacatctaagcggtcaatgtcggctttgtgcaacattggctgagtgatacgaggcagtaaagtgatgatgctgtttacatccgactgcattaaatcgagcaacttcaagcctttgagtgcctgaatgtttggcttacgcacctgaatttcggtaatggtctgttcagcacgcacaatgcctgcttttaatttgactgttgtcacatttggatcagttttctttttcattgttttttccttgtagggacacactgcgtgtgtccgttttcatcttagatattaaagcccaatcgccgcacggtgttgtgcataacgatctttgccgtccactttgaacaccgaattgattaaatcaatctcaatcaattccttgccgtccaccgttagcttgtagtaggaaagtgccgatttaatcgtagtttcggttttttcccctgttttgctactgccaccgtctaactctgtgtggcgaccacgcaccaacacttcaacggcggtaatttcgcctgtgtcgtcacgttgatagctacccgcaaaacgaattaattcgctgtcaatggtatctgtggcaaaccctttgaataactctggcacaatgcccgcgtatttgtgggttatttctaatttttctaagccttgatttgccgacacttcgcccaacataccgcctgtgcggaaaccttcttgcttcatcgtcaatttcggcaattcgacttcttctgctacgccttcataaccaaaaccgttattgaagacgttcatcaattttaataatcgtggtaaagccatattttttccttattcaacattcccccctttgaaaaagggggactaggggggatttttatgccgcagccactttcgctgcaaagtccatcaagtatttgtcggtaatacgctgacgtaaattcaggttttccaacgacggcatcggggtatagtcataatcaataaagaactgaccatctttgataatgtctttggtgttaatatcggcatcgacccaagccgagccgtccacgatataacctaaatttttccagtaacggaatttttggttgatcatttccagcatatctttcaccaaacttggtgtaagcggtttatcaatcgcccagtcgaacgcttcgccgaaggtgtccgcaataatctgagcggttcgggtgtactgctcaaaagcaaaaagtttatcgcttgataaggtgcgaccgccccaaatgcgatagccgttgaagttgattggcacggaaatgtttttctcattgagcatattcacgtcagtgcttgaatcttgaatatcaaaagacatcgggatagtgacacccgtcaccccatcaattactacgttagacaggtttttgtgccagccgacggttttatctaacaaggcacgcaagcccaatgcacgagcaacggcagagttcggtttgtaggattttgttgcagtgtcaaaagaaacaaaatcaccgtggatcatcatcaattcacgttgtccgaaattgcgggcatattgaatagccgcatcacgggttttcgcaccgtttgagctgatatagccaaaagcacgcaattttttacagatactggcaagctccgttgccaccgcttgattatccaattcaggcacgcctaagatgcgtggtttaaaaccgcagacggtatttgccaccagcaaggcttttaagcctgtgtattcgccttgctcagtcactgtaccaatcacatttgcggtgagtgtatcggcgttttcatcgtgggcaacacgcaccacaatcacaggggttttaacggaatcaccgatagcgtcaagactgcgtgccaatgtgccttgtgtgccagctttgccaattgcagcgacaggatcggtaattaaaacaggtttattgagggggaaagttgcactgtcggcatcatcggcagtacacaccattccgataattgcggtggcaatggttcgaattggtcgtgtgccttcgttgatttccagtactcgaacaccgtgtagatagtccatagaaaatccttctgtttaaataaaaggggataaattgaaggctattgtgaaaagaaaaccgccctgaagcgagcggttggaagtgtggatttggggataacaatcagcggattttgctaaactctgggggatattgcttgcgtttaacttcgctttcgtaggcggtttggcaatgctgtttatcaaaaaacagcccattgacaaaagcaaaccaaaaacgccaccgcttgcgtggcttctcggcaagtatcgccccacggtagcaacggcttgaaaaggtttcatctgccgcaccgcctgttagggcgttaaatagttggtcaatggcaatcacaacgtgatacaaccacaatagcaatttagatttgttcatttacaaactcctcataagtctgcgtccacccactcgaataatcatattcaagtggattttctacttgctccaccatcgctttatgcttcaaggcattagcgtgattgcccgtcttggcttccattaatacctgccaaatgactaacaatttttctttattaatcatcgccaccgaattatcggcgaacgtccacggaatttcttggtcgccgaataagtcaaatgtggccttaactgacaagatattgcgttcagcggtggcatcggtatcaatccatttgtcgatagctggcacataaacgccaccgttgattttcttatctcgcagagcgttgatagcattacgggtttgttggcgttgttcttcaataggcatcggcgctggttcaactaaaatcggaagcccttcatcatcggcaacgattagcttaccttgagcttgtccttcaagtaacaagcggtaggtttcttccgaaatttcacaagccccttcaggtacaaaaccgccgtggtcgttgttataaaaaccgtctttataaaaaattgccattgtattctcctatttccagcgaccaacacctaaaaattgcactcgacagtcaccttgattctcactgttgtgttcatataatttataataacaaacagcattggtgctttttctcataatagcactaccaacatcgctgtttataccataggtatgttccactttaggtatcaccataggtttatcagcaaaagcgacagcccaagtaaattgcttttctatccactctttcaaatcatttacatcataaaaataggtttgaatcatcgtcccatcagggtatttgcggatttcgaagttgccgattttttgataagtaaataacgctgtcactctattatcaaaatcattaatacctaaacctgatgcggtcgttggcttatttctcacttcactccaatccgctccgtcaatctgcttccacggcagccatctgttgccttctctgcctctcacaaattttttattgctgtaaaaggttgtgtactcttgctgataaccatacgcagatggcgtaaccagcaacgtccctgcctcttgtgcagggtagttgaggttaggctgagcgttggcatttgccatttgggagtacacgccatacacagtgacgtcattgaggttgcttacttctaatcgtgggcggagcataaagtactcatgcacgctcccccagccactggcattgttgccccattgggcaaaatgcctatcaaagtttacagcttggcgaaaggcttgggtattatctgttttgctaacaaaaccccacccgctgaatacgccattgccacttagctgcgcattggttgtaaatcctatatagctacccacaggcaactctgtgggcgtggcgttttggtactcaatttgagtattagggatatgagaccgcaagttgatttgcttgaccgggagcaggttgccctcgtcaaagactttattcgctccatgatagatgggcttgttgctctcaactctgtccgccttgaggtggacgccggtactgtattgatatgacacaagcgccacgtcgttgtcattatccctaactcgtccgacaaaccaatcatccacatcgttatttttacctcttagataagaggcggcgtggttgatattgagtatgccagtcattgtgtcgccagtcttcttaaccgcgtctgtaataccaaatccgtctacagtcgtaggtttatctctcaacgtactccattccgcgccatcgacccttgcccaattgctccaactattcgtactagcatcaaaccatcgctcataacattcttgtttattatgtagtgtgtagcgttgtagggttcctgtgcgaccctcaacaccgcctgacaaaacaaataacataccactatgcgcgacaggacgagacgtggcgtgtccgatgctaaaaacgccatcgctcttaaaatcatttaagttgatattgagcgagtcgaatcttccaaaaagccccccaatatcagcacgtttccaaggcgaccaattcccattaaatgacaatttataacgttcatatctatccccagaataagctctcatcgccacctgtctgtgccaaccagggctgtcaccagaaatcacctgtacataatagttatggctcgtaggcaaattcttattagacatatcgccgctaccataagagtaaatcccatcaaccactaatgtatcagcgtcgtcttgacaattgttgttaataataaatttatctaatcttcttttaatcgcaactccctgcgccgccgtcagtgcctttgtggcatcatcggtggttaggttattggcgagttgaactaagcctttttgggttgggctggcatcttgagctgtgtatttgctgttagctaaatcataagccgtttttaccgcttgtgaagaagctaccgtagtttgagatgttgaattgacagcgttactgatgtcggttttattgactttttgatttaacgcattattagtattaacctgcaactgtgccacagactgagcaatggatttacctgcttttgcggttaatgccaatacttcagagtctagtcctgtgtcgttggtgagttgggtaatccctttgcgagacgtagtggctgtgtcaattgcgtgagaatgtcctgtgtcatcaaaaccattgatactatttgcggtgatggtttttggggtaaactgtccccgtgtcacaaaaatcactgtatcatcaacctttaacgtgacagcgtccgacgaactcactaataaaatcattcgcaacacttgaattttgccactaccttcttctaatcgtggtttataggtatcggggcagttagcaatcgcaaccaatcgtcctgcattatcaaaaatccccatttcacgaatccaaaagccaccgacattttcaggtaaggttagctcaaaaatgacttggcgattgtttctcggatctcgactgactgcactgatactcgctttgtggacttctctcacaagtgatgtgcgagtagaatcaggctgtacagctcgcccattgccatcaccaacggcaaaatgggtaatgttcactgcttggcgatttgtcatcgcatttgcaaaaagttgtgaaccgtaggtagttaaaacggagtaataggtttttgccatagtgtttcctattgtggataaacggtgattgtctcaccgctattttgtccaataaatacattcatttcgcctgttggtgtaacagcaattgcaagggttaaatggcgtgaaacaggcttcacatcatcgactaatcgtacaagttcattgtaagtttgttcatttaaccctgtttcgctcacttcaacggtcagcttaaacgtccctgccgttcccattggtgtttcttgccaccactctttcacttcgagcaaatagccaataggctctacgacacgtcgaatagcggttaatgtgcctttttgtttatggatcaggaacgcatttttaattgcaatacgtttgacttcttcgctccattgctcgtcccatttatcgactgaaaatgcccacgctagataaggcaataatggttctggacaacgttcgggattgattaaatctgcaatcacaatcggatttctgaccgcttgttgtaaacattctgctgctcgtttttcaagcgtagtcgctccatttggtaaaagtggggcgtgattaataatcatcagaaaccgccatttctaagctaatttgtgtacaaaaccctgctttattattgggcaaaatcagatctgttcgtggctctaataattcgacccgttgaactccttcaatatgcaatgcagaataaatacctgataaggtaatatctcgccctaatcgacggcgctctaaggcgtatttttccaaacgtttttgcgcttcttgtttaatcggttcatattcaggaccacgaaacatatgtaatttggctctgatttgataatcctgaatagtagcagcctgtactgtaactctatctgcaatcgggcgaacattgtcatcatttagccttgcttcaaccgcttgtaataccgcttggctaggtatgcctttgcctaaacgggaaaggattgtcacggttacataggctggttgtggtgaaaccacagaaacatcgccgacttcaggatgagcagaaagggcgtggaatacataagcagaacgtggaccagccacagataagccttcaaatgccaattgagctcttaaacgtaaattttcatcactttctttgatttcaagtatcggcgggttagcttgtaaatctgcttcccgtacaatcattcgctgcacattaaaatttgcagcgatcacatctaagtctgttcctgttgcataagctaacattgtggcttttgcggcattgttaattcgttggcgttcaagtaactgtaaataacagttttcttccaataacttcgtaatcggctccgactccaacgctaaccgtgcttgccaaaaggcacgttcgctttcagggtaaagcgacagaaacttggctttgcgttcagccaataaggtttcgtagtcaagctcttcaatgacatcaggagctgggagtttggataaatcaactaattggctcatcgtaaggttaaatccgtcatcgttaatttggtgttactgctttttacggtggcatcaatggtgccagttaaactgtgggggctgtttaagtctgcaatctcaaccttaaacgccgtcacatcaattcggggctcccacattttcaacgccattacgcaagcagcagaaatttgcagaagtaaggcactggaaatcgggcggtcgataagctgatacaaattactgccataggtccgacgcattacacgagagccttttgccgtcagtaaaatgtcagcaatagactgcttgatatgctcgctttcatcgctgatcgttaagcctgtgtttcggttcattatggtgttcctgttcgtttgctaccgctttctacaccgctgtgggtatggctggagaggttgatgcctttaccactcacttcaccgcttgccgtcactgaacttgatgtactgattaccccttgcaccgacagtgttccttgaataacgacatcgcccgtgcaagtgaaagacggtgtctctgccgtaatgctttgcgtggcttgaatagttgcggttttgcaattttccaccgataaatgaccgcttgcgtggttgtagcgaatgacacaaccgtcaggaaaatgagtagaaaactcatctttgctttggctcggagcattggacgcataaacaccagcaagaataattcctgagttaaattcgccactgaccgcaagaattaaaacttgctcacctacgctaacaggcgaccacgtttttacatcgccagcacgcaaggtaatccacggcagaaagtcggtggtaataccgcctgctttcactcgtgcggtggcgttggcataatccacttcggctattgtgccaaggcgtagcaagttatctaatcggcgtgggtggtcgtgatgcacaataaaaatccgtcagttaaaaatggggatattgtgcgaaaggtaagagcaaagggcgaatggttgtgggtgtggatttggtggtaacaaaaaagcgaccgaagtcgcttgggtttagctaatacttatttaatcaatcccattgcccgcattagactttcttctgtcatttgctgggcataacgttcaacattcgcaaaaactttatattcttgtgggctgagtgctggcacttcacgcaatggcttttggtgtgtttcaaccactgcaaatactgcattatgtggcacttttgccataggctgagcttgtaaaataatcattgtttttctccgcttcataaagggaacttgtcagatcctaacgttgaacaagaaaattgtcaatttacaagcaaaagccccgataattcggggctagagtataagataaagggttatttattttttaaatacgctacagcaagtgtaccaattgtgactgttccaagtgttccagctaaccaatcgtgaccttctaaacctaagtaaatagcaccaagtattcctactaatgcaatgataagagagaaaactaaaccgattatacgttcaataaaagtataaaaattgatttttctgttttcattgcgtcttgtttttgcttcttcttgggtttcatttactacaaaatccactaaatcaggacgaaattgatgtaatcgttcaagttgctcaacaggtaatagcggactatcagaatttgtacttgctatggctatttcattcccacgactatctctcgcttgcgctttaacgtgtttggctgccatattgtctatataccttttgtgtattgcgatttagcgtttgcataacattattgacatccgattgtaaattttctctatctaactgaaaaccatttctgataggttgatacgatctaggttcagcaattgcagaaaaaagagagcaaaaaccattagtgatattttttaaatgttccatttggtcttccttattttgtcaatgggttatatcctaaaatataaccttttctatgtcaaataagatcaaaagagatcactttaagcattcaaggtcacttatcccaatatcgactgcgagcttttgcttgggcgttgcgttgttgcttttcaagttcccgtgcaacaaggcgagcaatttcttccgcactctgtcctgcggttgcattgacggtgatattgaccgactgattaacaggcggtggggtttgtcgttggatttgcgttggggcaatcagtgggcggttatccacttttaccgcaggcataggctgtgccagtgccaccgtagaagctaacgcagccatacctgcaacaccgccgtaatttaagcggttgagattagccacaccaattcggcttgtggcttctttggtcataacatattcgccaccgtgtacaatgcctttcggctcgtacttgccaccgttgcctgtgtagccaccattagcaaataaacggctatcacctgcagcgtccataattttttcagcagttgtacccgattttacaatacgctcactttctgcggttttggcttgattgacctgttgagtgatttttgttccagcttcaagacctggtaagttatcaatcacccatttaataccgtccatcaataatcttagtggtgtaagggcaatttcaatcgcatttgctgtccactcaccaaattttttacctgcttccgcagcagcatttaaactttccgcacttttatcagttggactaagtaaattcatcacccaccttaccgcttggctaatccacccaaccaatgagccaaaaatagccgtgagcggtttgaatttttccaatacaggtgcaagcccttgcattaaaccttgtaaaaaaccaccgaaaaaggctttgactttttcccaatgcttataaatcatcaatgcggcaaaagcgatacctaaaacagcaataccaactggagtaacagctaattttaataaaccgaaagtattttttacaatttgtaatccccgagcaagccctgatgccttggttgtaccatccgcaagcgtttttgcaaaaaatatacctttacttgcactaaatatattattggttttacctaataataagaacagtcttgcaaatgggtaatatgccaaacctgctgtagcagctaataaaccaaataatccaacgcctacagtcagtccgattgcccattttactattgattttgccatttcaggatttgctttaatccaatcccttactatttcgagtccatgactgattgactccatcagttccacaataggttctttcatttcaaaaccaatatcggcactagtattaaacaagtcatttttgaaaatttgccattttgacgacaatgtcgtcatccttgtttcaaattctctcgacatgcttccaagtgcttcatcactattcgctagggcaatttgtcgcttccattcttctgtgttggatacaagcaaagcaagcgttttagaatgttcggtcccgacaagatcagcaatgacaccaagtcgtttatgttcgggtatcttttggatagcaccaacaatgttaagtatcgttttctgtgcatcttttgccattccaagttcaacagaacttgcactcatgccaatactagataaagaatttgttacaggtttctttttgcttgcagatgataatctcgtaaaaatagcattaactgcagttgccgattgctcttcagttgctccagcagtttgtaatgtagagccgagtgcagccatatttttttcgctaattttagcaatgcctgcgatccccgaaactctgttcataaaaccaataatatccgtgccttttgatatagcgttatcatccaaatagttaataacatccgctaaatctcttcctgcatttgctgataatcggaagtttttagctacttttccgaattgttcaactaattcatcaggatttgtggcatcaaatgcagttgccatttgcgtatttaaacggacaaaatcttccagcaactcttttggcgtctccattcttgctgcagcagtaatcatttctgcaatttgagtggtcgtcaaaggcaattcttttgataatgcttggattttctctttccaaatatcatattctggggtgaatttaccgtttgcatcttttagcccttgtacttggcgtgcaacacctgccattgcgtcttcaaattccatgaaaaatgcgacaggttttgttaactgcgtgccgataatatagctttgtaacatcgcacgctgaccaacctcccccatttgaacactttgttctttaagagcttgtacattttgacgataagtagaatgttctttagctcgcttattgagagctatcaacttgctttcttggtcagtaatttgctgattagccagcttcattttatggctaagctcttgctgtgcttgtgataaacgtctggtattaataccactacgttctaaatctgcacgggtttcacgcaatttttgattctgtttagtttgttcaatttcgagtttttttaccgcattacgtgctttttcaaaggctttttgcattttttgtgttggttgtgcggtggcatttagctgtcgtgctaatgcttgtgctttatttttcgcttcttgaatttccttattactttcgaaaacggccttttttgtctgtctaaattgatcaatcagcttttgctgttgttctaaagactttaaatttgccttggttttcaataatgcttcagacattttgtttgcctgagttgcaacagatttcaatggagtcgaaattttatcgacggctgaaagtaatacttgaagttttaatgaattgctcatatatttaacctagataataactttaatgggggtaaatatggacttattagcttattttattatcggctcttttatcctagccattttggctcacgcatttatgggttttgcgttttttatcgccttgatagttgctgcaattaatttcattttttatccatttattattcttgtttcgttgtttattccaaaagcaagaacagaattgaaaaaaacttctgaacaatattcaaatactgttgaacaagaaatcgcagcaattaaaagaattagtaataatgtaaaaatataatttctaaggcggtctaaccgcctttttactgcccagccaacgccttaatcacaaaattttcaatcatttcaatatcttcatcggtaaagcctaacaactcacgctgatcgtatttcaccttccaatttgcacttctcaccactcgcccttccaatccgtattggtgaatttgtgcaatatgtgcgtcactgccactgtaacccaactcgatattatccccagcggttcttaacttcataaatcgggacgacttcaattttaagaacatcgcattttgtttaatctttcccttgcgttttttacgttgtactttgcgtggcgtgtacgccgtgccgtcaggattttgctgtgcggtaatgcgtctgcgttggctacgagccaattcacgcccgatttgttgatatagcaagcgtcgccgtggtttgctgatatttttgagcaacgcattaaacgctgatttaaccttgataatgtcgtctgtcgccattattccaccgctcccatttgctcatacaccttttcccctttcacaaaaattgtcagacgttccattgcttgccattcggtcggttgtggctcttcggcgtggtgaacttggtaatgatcgccttcttgtttgacaataacacgttcggtcagcggtattttgatgtaaatgtcgtgggtggcgttgttgtttgggtcaatttcaaaggtgatgctgtcctgtttgttcggattggtcatcagctccggttgttgcaagcggacaaattccatcacaggcacaaacagcaaatcggggtgttctgggaaatcttccaccacaatttctaagtcataatgatattggtaactgagcgatgtcgcccctgtcgtccaaattttgccgttggcatagaaaatctgtaactgttcgggatttttcgcaaaataaggaatggttttggtgagcaagtcacgcagtttgtcaggtttaatcatttgcgatagcctttttgtttgtattcgtaaatttgttggcagtcaatgcaacgggtgcaaccttgcacgttttggcgacgaacttcggggattggttcatcacaatcttcgcaatgggtcaggctgtaagcggtcggtttgttgcgaagttttgcaagggcgaactctctttctttttcggcaagctcattggctcggtcaatttggtctttcatcgctttttctcgttgagttaaatagcgatattgtgagcaactggcaaaggtggggcgaatggttgtgggtgtggatttggtggtaacaaaaagccccgatgggtcggggcgatgattatttctgattacctagctgaataaaatcatcaatccgttttcgaatagctttcattctttgttgaatatatttctcttctttggttccaaataaagtgtcgtgatctaccataaaacgaaccgatacagctgtttcttctgggttatcttcatattcaaaagtaaggataacaagtggatcgttttcagtataacttaggcgagcgtggtataaaccgatataatagggcgaagcaccataagataagctactatcttttgcccgaccaaataggcgatcttggttttcaatgtaaatttcaacaaattgctgttgttgccataaggcgattaattctgccaaatttgccgaatgggtttcaatatcctgttcactaaaacctaaagcaaggctaatttcagtaaacaggcgatggatttcaacaaatttaatatgtttgcgttctaacattttgatttgattgttttaattgttgttgtagtaccaacatagcatttttttgaatttcttctttggttttaccgacaattcgtgtgccaccaacttgttttgtgcgttcaacaatttcacgaatataaggtgcatttttattcatattgtccctccattacatagaaaacgtacaatatattctgcattgtcggctttttattttcagctgtcaacaaaaagccccgactattcggggcaatcattactcttgaatgcgcttattgtaactttccacacacgcttcccagccttgaatttccacctgacaaagctcaatggtcgttaaactttggtcgagggattttgcaagatcagcgttggtctttatctcgaacttggggctgtgacactgctttatttgggggcaaagtagcggaattggctttactgttcgatactgtaccgcttctttggttgagcaaccgactaacgccagtaggcacaggctgatagctccaagattgattgttttccaattcaagtaaaatttcattggtgcgtttctccgcttgggtgagcttagttaaaacttgttgatgtaatttatccacctgcttttgatactgcagaatatgttggtttgcctgttctagctggttggctaggctttggttatccgctcgcactaaagcaatttcttcttgtttggattggttgtccgcctgcagtgttttgcgttcataacagagaaaggcattaatgcagacaccaatcagcaaggcgataatcatcgctttgccaaaacttttctcaatcataccgcttataatgctaaacataatgctttttccttttcacgtcggatttctaagccacgcagttttttgccattggcataaacccaacgactaaactgttcacacattgcagggctgtaaccttgattggcgagtttgaacaaggtcgaatgtcgcattgttccacaacctgcattgaaggtaatagatgtcaaagcatcaaacgccccttgtggcatttttttgccgttggcgtagcggtttacgcaccgttccgcttcggctaaatcttttgcccagcggtcagcaatttctttgtcgctgtaaattttgcgttcaatcttaccgcttgtggcttcggtcgagccaatgccgacggtgagtatattcgcagggcaaacataaggatctcgtctgcacccttcagcattgccgataatcgctaagcctttttgactggtgcggatttcagggtgattaagctgtactaagccgataattgcacctataccgcagaccatcgctccgccgaatttaagatttttgttcatcgtctaaaatgtcctttaagttgattttgtaacgttcaagggctttttctttcagtttgatttctcggtctttgtagtaccaattcatcaatagggtaaacaagccgaataaaatccccataatcacgccccaatcgggaaggtttaggctggttaaaacggtcacgaatgcccccaatagtgacgtgttgtcatttctatccattttgattaatcccataggctcaccgtttgcttggtaatcgtggttgtgatggtgatgtctggcatttcgacccgttgccccatttccaaaattgccacatttgccagttgcggattgtattccaatgcaatttccaccaagccagccgttctgctgtaatgcctgaaaatcagttggtcgagtgtgtcgtgttgggttgcggttaaaatcattagataagctccgatgtccaacgtttacgtttgagcatatcccgaatagcgaaccgaccatcacggcgtaggtcatctacagaattttcaaactgctccgctttttctgcaccttctttggtgctgtcaaaactgcggtagcgttcgtagagatttgccattgcaaaacagaatacggctcgcttgtaacgagtaatcatcaggttttcgccgttgatatgatctgacggtatgtcgtcaaaggtggcgtattccatttgtaacgtgtgtaattccgcattgacggttgccattgcttcaatcacggcaaacgttaggcgttcatctgtaactgtgccatcggctcgcattgcgtggcgaacttcgacaagctctatatctgggaaaaagccgttattgctaatggtaatttgcgtgggtgaagatacctgatttttatccacgaccactttaggtatattgatgacgtggctcatttgcaatctatctccataatctgaccgcttgccaataaaaaaacggggtgggggctaatcaaggcaatcaagatcgctttttcgcccgccccgtcggctgcgtggtttgctcggtttagtcggtgtcggcttggtttaactgcttccgcaattttttaatactgccttgcacaccgatatttaaattcagttctaatgcccgttctaagtagctgagtgccttttcaggctgtgtcgtttcaagtagtaagccgatttcacgatagagccttgctcgactttcgtctggcatatctttctctttggtgagttcgtccactcgtaacaagtagcttacttcaaacggcttttgcaccttcagggcttttttcgctgcgtcagcaaactcttcagccagcattgaacaaagcgaacgactaaagccgtcaggcaatgtcaggtcttgatgaatggcgtaatcggcaatttgtaaagcaaggtgatactcgccacaatccaccgaccacacttgccacgtcatcagcacattgtcctgtttgccgttgcccgcactcaatgccccttcaatccacggcaaatagtggtgaagaatgcttttcttataactggctcgctgttccattgaggcaatggctttcaggtcttttttatgacgtgccagtaagtagagcattttttcgtattcgtcgaggttttctagttgagcttgctcagaagattgagcaagctccgcagttactcgcaaatagtgggcttgagttggtcgcattaaccgcctactccagtagtatcaggtgaaccgagcacactaatgtttttcaacaatgcgacttgtgcataattttcgacaacgaaatcatcgttagaagaaacgaaatcttcgtagcgatcgtattccgcattatcttttaaagtgcgacgcattccgccttcttgataataaatcgacagattatcaaggcgtgtaattaagattgtccctttaggcaaatacggcacttgaataacacgtaaaccaccgcaacgtttttggctgacgatagtgtcgcctgctagtttttccgttggtttggcttcattgactaatgggaagtagtaatctgccaataaatcacggctcataatggcgacaagctgtgtgtcgtcttgatattgtggttcaattaaatcattaacggctgaaaagactaatgcatctaatgttttaaaggtttttgctgtactgcccacttcaattttattagagctttcgacttcttctttcatcacacgttgcggagcgtgttcttcgattttagctaaccaacctttcgccacatcttgtaataacggattagtgacacgattagagtcttttgcacgagatgtaccattaaaagcaatcataattcggtcaagtgccattcgttccgcttttaattcaccgactttacgttggaaatcagggaattttgcccacatatctaatgtgggataacgtaaatggctgtcgtagttaatttgttggcaatggtaggcaaccgcattcaatgtatataaatcttgtgttttacgtccattttttgtggtatcggtcacgctggcaatcgttcctgcaatccccaagcctaaggtttctcctttagcttcaatcacaggtacaatgttaatcagctgtaagaatgctgaactttcttgcacttgcttttctaaacgttgttgaacacttggctcaacagtgaattttttacccgtaaaaatgtggttgtaatccacaccgttgtcttgtgctacacctgcaaggtaagtgttaaatttggtcgctgtttctggtttcatattctgtcctttttagaaaacacgttcattatttaattcaccacccgtaatttcagggcgtggcgtgtagccgtgttctggctcactgccgataacatcaacacggctttgtaaagcggtgagatcggcggataatttttcaaaatctgcacacaatgccattttttccgcttcggtttgttttagcttatcttctagctctgtaaatttttctgctaaaagcaactgtgcctgttcgtgttcagcaaaacgagcttcaacgtcggctttatgttgggctgtgtcagctttttctttactaaacatcgctttcattttttcaaagaatgacactggctcttctgcaaaggtaagcgaacattccaccgcttcagtggtaaagatttcgccttgctgttcaccatttttcgttgtgaaagagagatattgggtgcctaagcttgctggcgtgtcagtcaccgctaaacctgtcaaataggctttgcctgttttggcaaaattggtgcggacttcgattgaggtgtaaaccttctgcttactattcactaactcgactaattcatccgttggctcaatttgtgcataaagctgtaatttgccttcgtcattctcttctgccttaacggctaacacatcaccgtagcattttgaatgggcaagttcagggtcgaaccaaaacaagtgaaaatgttcaaggttgatacgagcgccgtaggttttcgggtcgtacgtttcggcaatatcagaaagccactggcgttcgatctgacgaccgtccaccgttgctccttctgtggctaccacaaaccagttggattttttcggcataaatgcttcctcgaaatgagaatgttcaaaattgccgatatggtgattggattttcaaacaggtgcaaagcgttgcggttgttaagcaggatttaacaaaggggactgttctacaaacgccgtccgtttcataacaatagccatattttcaacgatgacgcaaaacaatgacggatattgcaacaaaccaagcggaaaagaccgctttaattaatatgaatacccaccgtgaagcacaattaaagtattgggctggctattcactcacggaaattgccaaaatgcttaacattcccgtgtccactatcgccagctggaaaaaacgggaaaaatgggacgaagcacctttgtttgaacgtgtgagcggtaatattgagagccgttatatgttgctgttacaaaaggacgtgaaaacagggtacgattttaaagaattggattttttaatgcgtcaaatgaaagatgccgcacgcattcagaaatataacaacggcggtaatgaagccgatctcaatcccaaaattcaaaatcgtaatcggggtgaacgtaaacctgctgagaaaaatccgattagccctgagcaagaagagctgttgattaatggctttatgcaaggaatgttccaatatcagcggaattggtatcaagcaggtgaaaagcaccgtattcgtaacattctcaaaagtcgtcagattggtgcgacttattatttcgctcacgaagcctttattgatgcgttaaaaacagggcgaaatcagattttcttgtcggcaagtaagaagcaggcgttaatgttccgctcttacattacccagtatgcacgcaaaaccgccgatgtggagctgaaaggcgaaacgattttattgccgaatggagctgagttgattttcttaggtaccaattcggcaacggctcagtcttatcacggcaatttgtactttgatgaaatcttttgggtggcaaaatttgacgaaatgcggaaagttgcttccgcaatggcttcacagaaacagtatcgtcaaacctacttttccaccccaacgactattgctcattctgcctatgacttttggtcgggtaaagccttcaaccgagatcgccctgaaggtgaacgggtggaaattgatatttctcacgctaatttgcgtgcaggtaaattgtgtgccgaccgtcaatggcgacagattgtgaatatctatgatgccgaattaggcggttgtaacttgttcaatattgacgatttgaagtttgagaactcaacggcagaatttgagcaattatttatgtgccagttcgccgatgataattccagcgtgtttaaatttgatgagttgcaatattgtcaggtggactcgtacgaagaatggaaagacttcaagccattttatcaacgcccttttggtaatcgggaagtttggatcggttatgacccagcatttacgggcgaccgtgccgccttggcaattattgcaccaccaagagtagaaggcggtgattaccgtgtattgcatacggacacctttcacggcttagattttgagaaacaagccgacaaaattcgccattacacccaatcttacaatgtgacgaaaatcaccattgaccgtacaggtatgggcgatggcgtttaccaaaatgtgaaaaaattctttccctgtgccgtcgggattacttacaacgtggatttaaaaaatgagatggtgctaaaaacgctcaatcttatccagaaaaaacggttgaaatttgacggcaaagagatcgctacaagttttatgacgattaagaaacagaccacccgaagcggtcggcagatgacttatgtgtctgaccgttctgccgaagccagtcacggcgatattgcgtgggcgattatgagctgtttagtgaatgaaccttacggcaatgcacaggcttctaagcggaccattattccttttaataactaggtgatttatgaaaattgaacaatttacttttggcgacccaacgccagtgttagacaatgccgatattctgaattatttcgaatcggtgttgatgtatgagaaatattacaatccgcctgtcgatttttcaggattggcacgggcagtaaaatcgtctgcacatcatcagagtgcgttagcagtgaagaaaaatattctgatgagcacctgtcaaacatcgccgttgttgccacgttatgagttggaaaaagtggtgcaggactatctgattttcggtaatgcttaccttgaaaaacgaatgggcaaggaaaagcaaattttagggctaaacgcaccgcttgcgaaatatgtccgccgtggtcgagagcaaggtaagttctttttgctggctaatggctatcaggagtacgaatttccaaacgatagtgttttccatttgaaacagcctgatgtcaatcaagaaatctacggcttgcctgattatttggcttcacttcaatctgcttttctcaatgaatctgccacgctttttcgccgtaagtattatttaaatggggcgcacgcaggaagcattatttatatgaccgacccaatggcaagtgaaacagacgttgatgatttaaaagagcaactccaacaagctaaaggcaagggcaatttcaaaaacctgtttttgtatgcccctgatggcaaagagaatgggattaaagtgattccgctgtcagatgtggtcgcaaaagatgagtttctaaacattaaaaacaccagcagagatgatattcttgcagcccatcgagtgccacctcaactgatgggtattatcccgaataatacaggtggctttggggacattgaaaaagctggcaaagtgttcttcattaatgagatcttaccactgcaacaacgacttgccgagattaaccaatggctaggcaaagaagtgattaccttcaagccttacatacttctcgaacaataacctaccgccccgaattgtcggggctttttattgcctacaaccacgccagcccctcacttacgcctgaaatatcaagccttcgtttgcctgatgataaataattccgccccacgttattatactaaaccgatctgctaaccaaagcgaaaaaataaaaaatcgcccattttttcaccctttccccaccccaaaaatcgcagtcaaaccctccacgcccgcacactaaatgtgtcgatttttacgcaagtacaaaatctcgatcttcccaagccacacaaaaggcgaactagatctttaattcagatcttttttactcatttttatacaaattttcgcaattttgcagtatatttatgatcgggcttgattatggtagtaaggttggagtattaacactataattgatacttatcctgttgataagtaaaggcaatgaacagatccaacatatcggtacacgcctccatatctaaatttataattacttataacgtattgacttttaagcaataaattatttcgctaaatgtatggcgtatgcatctatatcctagataaaagatcaccctagaggagtgataatgctcattaatctacaacttgaacaaattcttgatgaaaaactcaacagtaaagccattgcagattatgctccaaatggcttacaggtcgaaggtcgtcgtgaaattcgcaaaattatcacaggtgtcaccgctagtttacccttaattgaacaggctattgcgaaaagagccgatgcaatccttgttcatcacggctatttttggaaaagcgaaaacccttgtattcgtggtatgaaaggaaagcggatcaaacaactgctagtcaacgacatcaatctatttggctatcatcttccccttgatatgcacgcggaattaggcaacaacgctcaacttgcaaaacatattggggtaaaaaacttacaaggtttggaagataaagctctctctattcccgtctatggtgaattagatgaagcgatttcagcacaagagttagcgaacagactagaaaaagctcttaagcgtaaaccgattttatgtgacgaatttattgcagattttccacaaaaattaattaagactgttgctatctgtaccggcggtggacaaggttatattgatttagccgcaaataaacagatcgatgcctttattagcggtgagatttcagagcaaacgacccattcggcacgagaacaaggcatttactattttgcttgcggacaccacgcaaccgaaagagatggtgtgaaagccttaggtgaatggctggcaaaagagtatggattagaggtcgaatttattgatattgataatcccgcctgataagccccataaagttactttctcttgaaacccaaaagcacttttgataggggcctgaacaaataaagttgttttcattgggggcatagcaactattttgtctactatgcctatatatttagccctttatgttatctgtcttcccctcaacaaattccgtatccacgttcgatttgtgcttaacccttgcaaaatatcttggctcaggggaagcggttcgccacaaatttggctggctaataattcgcccaataaaaaggcggtggttaagcctcgtgagccaagccctgcgactaaatagagatttggatagcagttggcagtttcaatcggctctcgacggcgaaattgattatacaagttaacatattgcgttttttgtgcttcaaaatccggcacagccccgaccatcggcacacgatctcgaaatgccgcacgaatgccgactttggcaagatttccagaaaaatcaatctgttgcgtccattcacaagcggtcaaattctgctgaagttttgcaatattttgctcgtgttccactaaactgaactgttcatcggcattgtctcttaaatggcttgccccgatacaatgggtctgttgagctgagatcggcgttaaatagccatcataacaaaccacacattttaacttcgacaaggcttctgtcgttgggatttggctgacttgcccacgcacaggataaaggggaataccgtggctctgagcaaaatcggttaataaatgcccgtttgccaacactaaggtttgatgggcgaaggttcgcccttgatgttgccattgccattttcctgcaaaccactcagggttttccacctgatggtttaacaccactttcaaacctcgttgttgcaataaggtaaaagcattttgtacaaactgcacaggtgaaagccaaccgccctgagcaataaaagcaccaccattttgtaccgttaagcctattttttcactcaaatcttgagctgaacagagttgataaagttcactatcccaaccttgctccgccattttttgtagtttgtgtgcggttttatcgttataagcatataacgccacccctgaaaaattgtgttcaaatatgaccacttgagccaactgcttaaaacgttgcaacgcataatcaaagctatgcacataaaaacgcacatttcgctcatcatcgtcgctgagttgtgggtaaatcgccccctgtaaattgccagacgcattttttgctaactgttcatctttacaataaagtgtgacctgtttgccccgttctagcaaagacaaggcaacagcaaggcttgcaataccgccaccgacaatcgccacatcatcgctctctgtttggttagattgataaaaataaggaaagcgaatgtggttttccgtttgattgtcaggcttctcgccccacagcatttcacgttttttgccgaaacctttacgttttttcacctcaaaaccgaccgcttgcaatccacggcggacattgcttgatgcggtaaaagtcgcaaaagatccgcccgcttgtgttaggcggaacatttgctgataaaggctttcgttccacatttcaggatttttgtcgggcgaaaagccatctaaaaaccagcaatcgatcagattgttataataatcgcccagttgtggcaaattctctaataggttgccaaaccaaatatcaaggtaaatttgttcaaaatggtaacgctgacacccaacctgtctaggttgccaacaagcgataagtttcgtggaaaaatctgcaaattgcggataatgttggtgaatttgctgtaattgttcggcttttatcggaaatttttcaaaagagataaaatagagccgtttaagtggtgaagtcggatattccgctaaaaatgccttaaacttttctgccacagcaaaaaaattcaaccctgtcccaaagcctgtttcggcaatcacaaagaaagatcgggggtgtcgttgccatttttcccacagttgattaccctcttgaaagacataatggctctccgccagcccatcttgtgtagaaaaataaatatcatcaaactgtgctgaaacaggggtattggattgattaaaatttaaagaagcaaaggtaatttttgacatagcttatctcataaataaaaatggtgagccagttacccaactcaccacttcattaaactgcaacattagaaaatgttgattgcaaacatcacaattatgcctaatgcaccaacaactgttaataatgcataacctagtgtacccatttttatactcctgtagaaataaatagtcttgacattctaaggtgatttttgaaaaaagcaataaatatacttaaatatactattgttcctatgtttcttaagagattttcataaatggccttccccctttttttcttctaagagctagagaattatttctatgtttagaaagcataaatattcaaaaaaatatttgtcattattacttaaacaacgtattatagccatctagacggaaaaacttctaaaacaaatttcttacgagcggtaagtattgacgtattttttgcaatatcttactgcttgttgaatttcttagggtgcgttaatgcaccaaataacaatcatggtgcgttagttgcgtaccctacaaggaataattatggctatcaatctatttacatcagaatcggtatctgaaggtcacccagataaaatcgcagaccaaatttcagatgccgtattagacgaaattctcaaacaagatccaaaagcacgtgtagcgtgtgaaacctatgtaaaaacaggtatggcgcttgtgggcggtgaaatcaccacttctgcttgggtggatattgaaaacttaactcgccaagtgatttgcgacatcggttatacccattcagatatgggctttgatgcacactcttgtgcggtattaaatgctatcggtaaacaatcgccagacatcaatcaaggtgtagatcgtgctaacccgttagagcaaggtgcaggcgaccaagggattatgttcggttatgcgacaaatgaaacggaagtattaatgccggcaccaatcacttacgcccatcgtttaatggaacaacaagcgaaagtgcgtaaatcaggtaaattagactggttacgtccagatgcgaaaagccaattaacctttatttacgaagataacaaaattaaaggcattgatgccgtggtgctttcaacccaacacgcagaacacgttgatcagaaaaccgtgtttgaaggtgtgatggaagagatcatcaagccaatattgccaagcgaatggttaagccaaaacaccaaatactttatcaacccgacaggtcgtttcgtgatcggcggtccaatgggcgactgtggtttaacgggtcgtaaaattatcgttgatacctacggcggtgcagctcgtcacggtggcggggctttctcgggtaaagatccgtcaaaagtggaccgctcagcagcctatgcagctcgttatgtagcgaaaaacattgtggcagcaggcttggcagatcgttgtgaaattcagctttcttatgctatcggtatcgcagagccgacatcaattatggtggaaacctttggcacaggcaaagtgagcaatgaagtgttagtacgtttagtgcgtgaacattttgacttacgcccatacggcttaatcaaaatgttggatttaatccgtccgatttatcgtgaaactgccgcttacggacacttcggtcgtgagcatttcccttgggaaaaaacggataaagcagaagcattgaagagtgcactaagataatgaaaatattgaagtagattatactgggattagtctacttcaatcactttttaagcatttggtatgcgacatagtagacaaaagcgttggtaaaaagtgggctaaagccttataacacaaggctttaagcccactttttgaaatatgaacaaaaaactgtcctttttgccttaagaacaatatccaaaaatatcactgttccattagaactattcaacgttatattgaaaaatcccccaaagctaaattaattcctttacaacaaacctatctcaatattattgcagacgtgaccttctttggtcgtgaatttggtgtattagttttaatagataccttatctaaatcaccgctttcattagatttccgcctattatttctaactttatattgataaaagttgaaaaattcctgttattttatctttacattgtttttttttttttacaatgggagggttcatttgtacatcctgaaaatgtaaataaaggtttatgatgctttattaggaaaagcggtagagaagattattatgaataaaatatttagagttatttggagtcatgctcaacaggcttgggtggttgtatctgagttagtaaagtctcacaccaaaacatccgcttgcacggataaaagagctcaagtatgcacctcacattattttttagataaacagcaagataaatttaaattaagttttttaagtctagtattactaggtatattttttagtccagtaggtttagctgcacattttcaagatggttctggacccggaaggaatgaagaggctgacgatggtactattggtattggtaaagatagtaatgttgggcctggttctattgtcatcggtcagggcgcaaaagctgaaggtaggactagtattgcgataggttatcgagctgaagcagtcctttacgtacccaatgccgtagtcgttggggcaactgcagaagcattcggttattctgcggcttatggttatggagcacaagcacgagcaataggctctgttgcagtcggtgaaaatgctattgcaaatcaaaatagaggcactgcattgggtaacaattcatctgttaacgttatcggtggtgttgcattgggttatttatctagagcagatacggaagggggtattgaaggagcaaaacaaactttttctgtgacagagagagcaagcactgttgagaatggctttaaatccacagaaagggttgatggtaataagattggtgcggtttctgttggtagcggtgttgcttggaagaattcaaataaaccaatcaaacgccaaatcgtcaatgtggcggcaggtaaagaattaaccgatgcagtaaacgtggcacagcttcaatcgctcaccatgcaaataggaggcgataacggcagtggcaaggtaggcatttggagtggtacgctcaacgtaaaaggagaaaatggtattacttcccatgctcagggcagtacgattacggttagattagaggacgaactcaaaaataaaattgataggattgccgctatgggtaagttaattgaacgtacggaagaaacaaatgatggtctaaaaattatctatacagatggtacggataacactatcaagaaaggtgaaaaaggagatcgtggcgaaactggccctgcgggtccaacggggcctaggggtgaacagggtcctgaaggtaaacaaggtattcaaggacctgcgggtccagtaggtccaactggagcacaaggtgcacctggtcctgcaggtccaaaaggagatgcaggagaaaaaggcgataagggtgaccctggtgaagcaggagcagtgggccctcgaggtccagcgggtgcaactggtcctgcgggtccagcagggcctagaggcgaagcaggggctaagggtgaacagggtcctagaggtgaacaaggtattcaaggacctaagggtgacaaaggtgataccggtcagaaaggtgaagctggccctgcgggtccaacggggcctaggggtgaacagggtcctgaaggtaaacaaggtattcaaggacctgcgggtccagtaggtccaactggagcacaaggtgcacctggtcctgcaggtccaaaaggagatgcaggagaaaaaggcgataagggtgaccctggtgaagcaggagcagtgggccctcgaggtccagcgggtgcaactggtcctgcgggtccagcagggcctagaggcgaagcaggggctaagggtgaacagggtcctagaggtgaacaaggtattcaaggacctaagggtgacaaaggtgataccggtcagaaaggtgaagctggccctgcgggtccaacggggcctaggggtgaacagggtcctgaaggtaaacaaggtattcaaggacctgcgggtccagtaggtccaactggagcacaaggtgcacctggtcctgcaggtccaaaaggagatgcaggagaaaaaggcgataagggtgaccctggtgaagcaggagcagtgggccctcgaggtccagcgggtgcaactggtcctgcgggtccagcagggcctagaggcgaagcaggggctaagggtgaacagggtcctagaggtgaacaaggtattcaaggacctaagggtgacaaaggtgataccggtcagaaaggtgaagctggccctgcgggtccaacggggcctaggggtgaacagggtcctgaaggtaaacaaggtattcaaggacctgcgggtccagtaggtccaactggagcacaaggtgcacctggtcctgcaggtccaaaaggagatgcaggagaaaaaggcgataagggtgaccctggtgaagcaggagcagtgggccctcgaggtccagcgggtgcaactggtcctgcgggtccagcagggcctagaggcgaagcaggggctaagggtgaacagggtcctagaggtgaacaaggtattcaaggacctaagggtgacaaaggtgataccggtcagaaaggtgaagctggccctgcgggtccaacggggcctaggggtgaacagggtcctgaaggtaaacaaggtattcaaggacctgcgggtccagtaggtccaactggagcacaaggtgcacctggtcctgcaggtccaaaaggagatgcaggagaaaaaggcgataagggtgaccctggtgaagcaggagcagtgggccctcgaggtccagcgggtgcaactggtcctgcgggtccagcagggcctagaggcgaagcaggggctaagggtgaacagggtcctagaggtgaacaaggtattcaaggacctaagggtgacaaaggtgataccggtcagaaaggtgaagctggccctgcgggtccaacggggcctaggggtgaacagggtcctgaaggtaaacaaggtattcaaggacctgcgggtccagtaggtccaactggagcacaaggtgcacctggtcctgcaggtccaaaaggagatgcaggagaaaaaggcgataagggtgaccctggtgaagcaggagcagtgggccctcgaggtccagcgggtgcaactggtcctgcgggtccagcagggcctagaggcgaagcaggggctaagggtgaacagggtcctagaggtgaacaaggtattcaaggacctaagggtgacaaaggtgataccggtcagaaaggtgaagctggccctgcgggtccaacggggcctaggggtgaacagggtcctgaaggtaaacaaggtattcaaggacctgcgggtccagtaggtccaactggagcacaaggtgcacctggtcctgcaggtccaaaaggagatgcaggagaaaaaggcgataagggtgaccctggtgaagcaggagcagtgggccctcgaggtccagcgggtgcaactggtcctgcgggtccagcagggcctagaggcgaagcaggggctaagggtgaacagggtcctagaggtgaacaaggtattcaaggacctaagggtgacaaaggtgataccggtcagaaaggtgaagctggccctgcgggtccaacggggcctaggggtgaacagggtcctgaaggtaaacaaggtattcaaggacctgcgggtccagtaggtccaactggagcacaaggtgcacctggtcctgcaggtccaaaaggagatgcaggagaaaaaggcgataagggtgaccctggtgaagcaggagcagtgggccctcgaggtccagcgggtgcaactggtcctgcgggtccagcagggcctagaggcgaagcaggggctaagggtgaacagggtcctagaggtgaacaaggtattcaaggacctaagggtgacaaaggtgataccggtcagaaaggtgaagctggccctgcgggtccaacggggcctaggggtgaccgaggagaaactggtcctgcgggtgcacctggtcctaggggtccagagggtccgaaaggtgaaacaggagctcaaggtccgatgggtccagcaggcccagcgggagagcgaggacctgcgggtccagcaggaccacgaggccctgcaggtgcatctggaccacaaggtgaaaaaggagatcaaggtccgatgggtccggcaggcccagcgggtgctcagggcatacaaggtccaaaaggtgatagaggcgaacaagggcttccaggggtagcaggtcctaagggcgatagaggcgaagctggtccagtgggtccagcaggaccacgaggccctgcgggtgaccgaggagaaactggccctgcgggtgcagctggccctgcgggtccagtaggacctaggggtgaacagggtcaaaaaggagaaactggccctgcaggtgcagctggccctgcgggtccagcaggtccaactggaccacaaggtgcacctggtcctgcaggtccaaaaggagatgcaggagcaaaaggcgataagggtgaccgtggtgaagcaggaccagagggccctcaaggtcctgtgggtgcacctggtcctaagggggataaaggcgatccaggacaagcgggtcctaaaggtgaacaaggtattcagggacctaagggtgagcgaggaaatgtgagtgtcagcggtttaccgatggagtatacaacggaagacggcaaatcaattatcaatatgggcggtaatttctatttggaagaacctgctaaagatggttcgattaagttaattccagtggtgaatgttaaaggtaaattctcaaccaaaacgcaaaatccagatggcagtattacgcttaagtcattagcagtaaaagtgaatttggcaaatgaaactccgatggtattaggtaatgtcgctgaaggggtagcagatacggacgctgttaatgtgaaacagttgaaatctgcgaaaactgaagtggaatctaccgatcacagtgtggtgattaaagagcgtcagggcgataatcagcaaatcgtgtatgatttggcggttgctaaaacgaaactcactgcctctaaggataaacgcaccattagtgcagcagataaaagcaaccattttgcgacaggagatgaagtcgcagtagcaattaataccgcaacagcagccgcaagaaccgaagttgaagcgggtaaaaatgtgaaagtgacttcaaaaacgggggcaaatggtcagaatatttacaatgtgagcgtgtttggagatttaagcgacattacttcaattagtaatggcgatacgaaagtatctttaggtaaagataagcaaggaaatccagttgtaaatatgaatggcgccagaattaccaacgttggagatggtagtgctgagggcgatattgtgaatgttcgtcagctcaacaaagtggtttcttctgtgaatacaggatttaatcaattatcaagagatattggtcgtgttgatgttaatgcaagagcgggtattgcttctgctgtagcgatggctaatttgccacaaatttttttaccaggtaaaagtgctatttctgtttctaatgcacaatatcgcgggcaatctgcctatgctataggttattccagaatttctgataatggcaaatggcttattcgagcgtctgttggcagtaatactcagcgggatactgcgattggaggaggggtaagttttgtgtggtaatctagcacctataaattagaatttcatgctcaatgccattgttattttaacaatggcattaatatctattggatttaatttatttgtggaagaaaaggttttatgacaggacgaacaaaagtatctctgaatattatttttctttccatgcttttggatattgtgcttaaggcaaaaaggacagttttttgttcatatttcaaaaagtgggcttaaagccttgtactataaggctttagcccactttttaccaacacttttgtctactatgccttttatgctattgacttaatactttatcatttctctttttgccattactgtagctagttttagctattttgtagtacggcaatataattacaatttatatccttattgatccaaaaattctttgttaaaggattaaaatggtatccgacgatttctttacattcaaaatcttcttgagagcaccatcttagcaactccgagggtttaataaatttttcgaaattgtgagtgcctttaggaagcattttgagaacatattctgcgcctataataatcaacatgtatgctttcgctgttctattaatggttgaaataaagagtaaaccatcttcctttaataaattcttacaactctgaataatagaatgaggattgggtacatgttcaagcacctccatacaggtaataatatcaaatttttcagtatccgttatacaatgttgttttagaaagtcttctacagtaatttgctgatagcaaatatttaagtgattagattctgcatgttgtctagcaactagtagagcatctgctgccatatcaatgccagtgacaatagctcctaaaccagccattgattcgcttagaattcctcccccacatccgatatcaagtactttttttccaaatagcccatttgttttgtcattgatataggcaagccttagtggattaagtagatgaataggcttaaagtctccttgaggatcccaccaagtttttgccattttttcaaatttctccacttcttgttgatcaatattattcataaattactcacgattattttaaagtagaaaataattagattgagagaggaatagaggacattgtgatttattcaatacttacagaagtaatgactatatcatgtttagggacatcagtatgccatccataattatgtgtagagataacttttattttatctacaatatccataccatctacaacttctccaaaaacagcatacccccattcttgaactacagttttgccaaatagttcttttgttcggtagtctaagaaagcattatctacaacattaatgaaaaattgtgaggtggctgaatgaggatctgctgtacgagccatcgcaatactaccccgtttattacttaaaccgttacttgcttcatttttaattggttctctggttggtttttctatcattcctacttccatacctccaccttgaatcatgaaattatcaataacacggtggaaaatagtattattgtaaaaaccttctttacaataagactcaaaatttgcagaagtaataggtgctttctcaaaatttagcataattttgatatcaccaagattagtatgtaatataaccatttttattccttaaatatgaaatgtaagtagaaacacagtatattattataagttttgacgaaattacaaaaactttcttaatggctaacgaaattacgtatgttcgatgatattttttacccaatccaaccccgaataaaaatcctcagagagataaggtttgagtttttgcaagttttcaatgataacggttttatcagggtggcaaaggttaatatgccccaattttctgcctgctcgaacttcttttccataccaatgcagttggctaaatggaatatctaaccattcattatgatgttcgatcccaataaggttcaccattacacttggtgcaataggtttaagctctggggttggtaaatcaagtaatgcacgcaaatgcaattcaaattgactgattgaacagcctaactgcgtccaatgtccactattgtgtacgcgtggagcgagttcatttatcagcagtttttcgcctactacaaaacattccattgccattacaccaacataattgagttcgtgcataatcgcagagagcatttgttctgcttgttgttggaatatttgttgatggggtagcgtgatatccgcaacgctgtaacgcaaaatgccgttttgttgtaagctatgggttactgggtagaaacgggtttgaccattacggaaccttgcacctactaaggaaacttcgccatcaaagggaataaatttttctgcaattacgtcaccaaataagtcaggggtaatttgttcgacattatctttagtgacaatccactgcccacgcccgtcatagcctcctgtacgacgttttactaccactttttcgccaatgttttcaaagacttgctgccattgctcaggggaacttaataactgccaaggcgatgtagagagattaagttgatcgagcagtgatttttgggtaaaacggtcggcaagttgtccgaaaacggaaagattgacaaagtttttatggttgcttaataaatttgttaaaggcgtttctgcccaacgctcaatttcagcggtaatcaaactgttttctgcgagatcgaatacgggatcgtcaaaggctaatggctggacttcaatgtctaatggcatacctgcataacgtaacattctgccaagttgcccgttaccaagaacataaataggggggtagagtgtgcttttttgcatagttatcccgtgtaggtcgggcatttatgcccgacaataattaccaaatatacgaagtcgggcattgatacccaacgattatgatcatatataagtcgggcataaatgcccgacctacattaaaaatactctgccaatggtttatctagtttttgattaagtaaaaccatcaatttaatgcgagctttctgtccgcttaatccttgggtgaaaatgaccccttgttgtttcagttgcttaccgccaccaagataatcatacacatcttgcgtaataccgttaaaggcacgggacaccaataccactgggatatttgcatttaatagggcggaaatccctgctagacaagatggcggtaggtttcctgcccctaaagcttcaaccactacgccgtcacaacggctttgagccagttgttctagtaagaagctatccataccgacataggctttgaccagttgaatgtttgatttttccaaacgatcaatcggaaagcgttcgtaagcggtcagatgttggaaataaattgcacggtttttggtaaccaaaccacaaggcccaaatgtgggcgtttggaaggttgctacgttagtagtatgggttttggtcacaaatttggcattatgaatttcatcattcataaccaccaaaacacctttgttttggctttcatcacttaatgccaccaaaatggcactttgtaggttaattaaaccgtcagagcctaattcattgctagaacgcattgcccctgtaatggcaacgggaacattcactttcaaggctaaatcaaggaaataagccgtttcttctaaggtgtctgtgccgtgtgtaatcacgatgccatcataaccttcggctaacactgcctgttcaatccgatcttttagcaactgccaatgtgccaaggtaatatggggcgaaggaacgtgcaaaatcgcttcttgataaagttgagcagggtgattgagtttagctaacgccgttaaaagtgggttttgagctgaaggtgatactttgccgtcttcgccttcgctcattgaaatagttccacctgtgtggagaattaataattttttactcatttaaattcgtgggtctggattgtctaacacagattgtgtttgttcattgcggaaagatcgtaattttagtgcaatttcagggttaaatgcacctaaaatttgtaccgctaataatcctgcatttgcagccccagctggaccaatagcaagagtgccgacaggaatgccttttggcatttgaacgatagagtaaagactatccacgccactgagcattgagctttttacaggtacacccaagacaggaacaatggttttcgctgcaatcataccaggtagatgagccgccccgccagctcctgcaataatcactttgtaacctttttgttctgcggtttcggcaaattcaaacagtttatcgggcgtacgatgagctgaaacgacttcaacgtgataaggaatgttaaattggttgagaatttgggttgcttcggacatagttgcccaatcgctttttgaacccattacaatggcgatttcgatgttggttgtcattttgtccctttggattgagtgtaatacaagcggtgagaagtgtatcacaaaaagcaaacgtttgcctaaagaaataatctgtgatgaagctaacattttaggctttgaaaaatagacaaaataagtggtttttgctatcttgaggtcaaatttgtctataaattttcaacaatttttgataaatcaaaaaaaagtcgttgaaaatcaaggcgatagacgctttcctaaaagtagctctacgaatatcagtagggctatttgccgtgttttattgatctaaaacaaaaataaataacggacttttggttaaagtttcaacggttggcaaaattgtaacaattttgcaatgttttattcatcagagaaaaaaaggaaaagactatgtcagaaatgttagcacatgacgtagatccattcgaaacgcaagaatggttagactcagtaaactctttagttaaagaagagggcactgagcgtgctcaatttattattcaacaagtaatgcaacatgctcgcactcagggtgtagggcttccatcaggcgtaacaactgattatgtaaacaccattccagtgtctgaacagcctgtttatccaggaaatcaagaaattgagcgtcgtattcgttcagcagttcgctggaatgcgattgcgatggtgttgcgtagtcagaagaaagatttggatctcggcggtcacatttcaaccttccaatctgctgcaaccatgtatgaagtgtgctttaaccacttcttcaaagcagcaacagataaagacggcggtgacttagtttattctcaaggtcatgccgcaccaggtatctatgcacgttctttcttagaaggtcgtttaaccgcagagcaattagataatttccgtcaagaagcttttgctgatggtttatcttcatacccacacccgaaattaatgcctgaatactggcaattctctaccgtatctatgggtttaggtccggttaatgcgatttatcaagcacgtttcttaaaatatttacaaaatcgtggtattaaagatacatcaggtcaaaccgtttatgccttcttaggtgacggtgaaatggatgaaatcgagtctaaaggtgcattaaccgttgcaggtcgtgaaaaattagataacttgattttcgttattagctgtaaccttcaacgtttagacggtccagtaaatggtaacggtaaaatcgttcaagaattagaaggtttatttacaggtgccggctgggaagtcatcaaagtattatggggcagcaactgggataaattattcgctaaagatacgtcaggtaagttagcacaattaatgatggaagtggttgatggcgactacttaactttcaaatctaaagatggtgcttatgtacgtgaacacttcttcggtcgttatcctgagactgctgcattagttgcagatatgacagatgaagaaatttggaaattacgccgcggagctcatgatacagaaaaaatgtatgcagcatttgaacgtgcaaaacgttcaaataaaccagctgttatcttagctcaccaagtaaaaggctataaaatccctgaagcagaaagtaaaaatactgctcaccaatcgaaaaaaatgtcattagatagcttaaaaggcttccgtgactacttccatttaccattaacggacgaacaagtagaaaacttagaatatgtgactttcccagaaggttcagaagaatacaactacttacacggtcgtcgtaaagaattaaatggttatttaccagcacgtaaaccgaaatttgatattgagtacaaagtacctgcattatcagaattccaagcattattagatggacaaccacgtggcatttcaaccacaatggcattctctcgcgtattaaatatcttattaaaagataaaaatatcggtcaaaccatcgttcctatcattgcggacgaagctcgtacctttggtatggaaggtttattccgtcaaatcggtatttataacccacatggtcaaaactatgtgccgtcagaccgtgatttagtcgcttactaccgtgaagcaacagacggtcaagtgttacaagaaggtatcaacgagttaggtgcaacggcatcttgggttgcagcagcaacttcatactccgtgaacaaccagccgatgatcccattcttcatctactactcaatgttcggcttccaacgtgttggcgatatgatgtggttagcgggtgaccaattagcacgtggctttatgatcggtggtacatcaggccgtacaactttaaacggtgaaggtttacaacacgaagatggtcatagccatatccaagcaggcgttatcccgaactgtatcacttacgatccagcatttgcctttgaagtggctgttatcgttcaagacggtatcaaccgtatgtacggtgaaaaacaagaagatgtgttctattacctcacgacattaaatgaaattaccgaacaaccagcaatgcctgcaggtgcggaagaaggtatccgtaaaggtttatataagtttgaaacagtagaaggtaaaggcaaaggtcacgttcaattgttaagttcaggtgcaatcatgcgccatgtacgtgaagcggcacaaatccttgctaatgaatatggtgtcactgcagatgtcttctcagcaccttcattcaacgaattaggtcgtgacggtgcggatgcggctcgttggaacttattacacccaacagaaaccccacgcgtaccttatgtttcacaagtgttagcagatttaccaacagtcgcttcaactgactatatgaaactttacgcagaacaaatccgtgcgtatgtgccaagcaagcactaccatgttttaggtacagacggtttcggtcgttcagacagccgtgcaaacttacgcgaacacttcgaagtagatgcacgttatgttgttgttgctgcattaagtcaattagcgaaagaaggcacagtagaaaccaaagtggttgctgatgccattgcaaaatttggcttaaatgtagatcgtattaatccgttatacgcataatcaaatcgtcgaataaatgtagggacacactgcgtgtgtccgagaaatttggcttcgatattcaacggacgcacgcagtgcgtccctacaagtggtgagattaagtaaattttttacaaatttcaccgcttataagaaggattacaaaaatgtcaaaacaaattcaaattccagatatcggtggtgatgaagttaccgtaaccgaagtgatggtcaaagtgggcgataccattgctgctgaccaatctattatcaatgtagaaggtgataaagcctctatggaagtaccagcaccagaagcaggtgtggtaaaagaagttttagtgaaagtgggcgataaagtgaccacaggttcaccaatgttagttttagaagcagcaggttcagcaccagcaccacaagcggtcgcagaagctgcaccagctccagcggcagcaccgatagcgagtgcagttgttgatgtcaatgtaccagatatcggtggcgatgaagtcaacgtaactgaaattatggttaaagtaggtgataccgttgctgttgatcaatctattatcaacgtagaaggcgacaaagcatctatggaagtgccagcaccaatcgcaggtgtggtaaaagaaattttagtgaaagtcggcgataaagtttcaactggcaaattagtgatgcgttttgaagttgcaggtgcagcaccagttgtgactccagcacctgttgcagcagcaccagctccacaagcgggtggttcaacgatcaaagaagtgaatgtaccagatatcggtggcgatgaagtcaacgtgactgaaattatggtgaaagtgggtgatactgttgccgttgatcaatctatcatcaacgtagaaggcgataaagcctctatggaagtgccagcaccaatcgcaggtgtggtaaaagaaattttagtgaaagtcggcgataaagtttcaactggctcattaattatgaaatttgaagtcgcaggtgcagcgccagcggcggcatctgctccagccccacaagcggcggcagcgcctgcaccagttgcagtagcgccagcgcaatcaggtaatgtatctggtttaagccaagaacaagtggttgcaagtgcagtttatgctcacgcaaccccagtgattcgtcgcttagcgcgtgagtttggtgtaaacttagatcgtatcaaaggtacaggtcgcaaaggtcgtatcgttaaagaagatattcaagcttatgtgaaaactgcggttcaagtatttgaagatgtgaaatcaggtaaagctccagcagcaggcaatggcgtagcgaacggtgcaggtttaggcttattaccgtggccgaaagtcgatttcagcaaatttggtgaaattgaagaagttgaattaagccgtatcaataagatctcaggtgcgaacttacatcgtaactgggtgatgattccacacgttacacactttgatcgtacggacatcacagatttagagaatttccgtaaagaacaaaacaaactggctgaaaaacaaaaattagatgtgaaaatcacgccagtggtgttcattatgaaagcggtagcgaaagcgttagaagcgtacccacgtttcaacagctcaatttctgaagacggtcaaaaacttacccttaagaaatatattaacatcggcgtagcggtagatacaccaaacggcttagttgttccagtattcaaaaatgttcacaaaaaaggcatcattgagctttctcgtgaattaatggaagtgtctaagaaagcccgtgaaggtaaattaactgcagcagatatgcaaggcggttgtttcaccatttcaagcttaggcggtatcggtacaacccacttcacgccaatcgtgaatgcccctgaagttgcaattttaggcgtatcgaaatcagaaatgatgccacaatggaacggtaaagagtttgagccacgcttaatgcttccgttatcattatctttcgaccaccgtgtaattgacggtgcggatggcgctcgtttcttaagctacattaacggtgtacttgcggacattcgtcgtttagtaatgtaattgatataagcggtcagatttgcaaaattttctgcaaaaaagaccgcttattgtagggacgcaatgcttgcgtccgcggacacacgtagtgtgtccctacataagaggaaaaattttatgagccaagaaattaaaacacaagtagtggtactcggtgcaggtccagcaggttattctgcggctttccgttgtgccgatttaggtttagaaacagtcttagttgaacgttattcaacccttggtggtgtgtgcttaaacgtaggttgtattccgtctaaagcattattacacgttgcaaaaatcattgaagaagcaaaacgcgcagagcataatggtattacatttggcgaaccaactattgatttagacaaagtgcgtgcaggtaaagaagcggtagttgcaaaactgactggcggtttagcaggtatggcaaaagcgcgtaaagtgactgttgttgaaggtcaggcaacctttgctgatccacatacgctagttgctcgtgaccgtgatggacacccaacaaccattaaattcgacaatgcgattattgcagcaggttctcgcccaattcaattaccatttatcccacaccacgatccgcgtatttgggactcaacagacgcacttaaattaaaagaaattccgaaaaaattactcattatgggtggtggtatcatcggtttagaaatgggtacggtatatcaagccttaggttcagaagtggaagtggttgaaatgttcgaccaagttattccagcagcggataaagacgttgtagcaattttcaccaaacgcattgagaagaaattcaaattaatgcttgaaactaaagtgactgcagttgaagcaaaagacgacggtatctatgtttcaatggaaggcaaagcgtgcaacgatactaaacgctatgatgcagtattagtagctatcggtcgtgtaccgaacggcaaactattagatgcaggtaaagcaggtgtgaatgttgatgatcgtggctttatcgcggtagataaacaaatgcgaactaacgtgccacacatcttcgctatcggtgacatcgtgggtcagccaatgttagcacacaaaggtgttcacgaaggtcacgttgctgcagaagtaattgcaggacaaaaacattacttcgatccaaaagtgatcccatctattgcttatactgagccagaagtagcttgggtaggtaaaactgagaaagagtgtaaacaagaaggcttaaactacgaagtggcgaagttcccttgggctgcttcaggtcgtgcgattgcgtctgaatgtgcagacggtatgacaaaattaatcttcgataaagatacacatcgtttacttggtggtgcaattgtgggtactaacggcggtgaattgttaggtgaaatcggtttagcgattgaaatgggctgtgatgcagaagatattgcattaactatccacgctcacccaactctacacgagtctgtaggtcttgcagcagaggtatttgaaggctctatcacagaccttccaaatccaaaagcgaagaaaagataattagagcgcaataaaacctctcggaatgagaggttttatactaatatgtaacctcttttttctcagaaattttcccatttccctgctaaaatatgccttgtaaatttaatgtgtttttacaggatacccaatgacagaactcaaccaccaaatcagccaaattattgccgcagagttagcggtgcgatctgaacaaatttttgcagcgatgactttacttgatgaaggaaataccattccgtttatcgctcgttatcgtaaagaagtcacaggcggattagacgatactcaacttcgccattttgaaactcgtttactctatttgcgtgagctaaacgaccgccgtcaaactattttgaaatccattgaagagcaaggcaagctcaccgatgaactgcgtgagaaaattgaacaaacgcagagtaaaacggagcttgaagatctctatttgccgtataaaccaaaacgccgtactcgtgggcaaattgcgattgaagcagggcttgagccgttggcggatagtctttggaacgatcctagccaagtgcctgaaacagtcgctgaagcctatgtggacgcagaaaaaggtgtggcagatgtgaaatctgcacttgatggggcaagatatattttgatggaacgtttttccgaagatgcagatctgcttgcaaaattacgtcaatatctgaccgctaatgccaccctagaagcaaaggtgattgacggtaaggaagaagaaggcgagaaattccgtgactattttgctcacagtgagccgttgaaaaatgtgccgtcacatcgtgccttagcgatgttccgtgggcgtaatgagggtattttgtcgctcaatttgaatgccgatcctgatgcggaagaaggtagccgttcaagttattgtgaagagattattcgtgagcatttaggcgtacaacttcgtcagcaaccggcagacagctggcgttcgcaggtgattgcgtggacatggaaaatcaaagccttgttgcaccttgaaacggaattaatgggggcattgcgagaaaaagcggaagaagaagcaattgatgtgtttgcgcgtaatttatccgcattattaatggctgcacctgcaggggcaagaaatacgatgggattagacccaggtttgcgtactggagtgaaagtggctgtggtcgataatacgggtaaattattggataccgccacgatttatcctcatacgggacagatggacgttgcaatggtgaccatttataagctgattaaacagcataatgtggatttaattgcgattggtaacggcacggcttcccgtgaaacggaacgctttgccaaagaagtgattaaagagatcaaagagaataaaccgcaaactgtggtggtgagtgaagctggagcatctgtttattcggcttcagaattggccgcaacagagttccctgagcttgatgtatccttgcgtggtgcggtgtcgattgctcgccgtttgcaagatccgttggcggaattggtgaaaattgaacctaaagcgattggcgtagggcagtatcagcacgatgttaatcagttgcaactggcacgtaaactggatgcggtggtcgaagattgcgtaaatgcggtgggcgtggacttaaataccgcttctgcaccattgcttgcgcgtgtggcaggtatgacgaaaaccttagctcaaaatattgtggcttaccgtgatgaaaatgggcgttttaattctcgttctgacctgaaaaaagtcgctcgcttaggaccaaaagcctttgagcagtgtgctggttttatgcgaattttaggcggaaaaaatccgcttgatgcctcaagtgttcacccagaagcctatcctgtggtggaaaaaatcttgcaagcaaccgcttctacgttaggtgtgttgatgggtaattcaacgaaaattcatagtttgaatgccaaagattttgtcgatgaacagtttggtttgccaacggtaaacgatattttcaaagagcttgaaaagccagggcgtgaccctcgtggtgagttcaaaacggcaatttttatggacggcgtagaagaaatcagcgatttgaaagtcggtatgattttagaaggcactgtcactaacgtaactaacttcggggcgtttgtggatattggcgttcatcaagacggtttagtgcatatttcaatgttgtcgaacagctttgttgaagatccgcaccaagtggtgaaaacaggtgatgtggttaaagtgaaggtgttagaagtggatgtggctcgtaaacgtattgccttaacgatgcgtttggacgataaaccaacggataaacgtgatacaagcggtgagaaacgcaaagagtttggcaaatccgaccgctcgcaaaagcctgaacgtcaaagttttggcaacaatgcttttgcagatgcgttgaaggggtggaagaagtaatctacttttttggtcgggacgatgacaaagtaatttggagcgttcttaccaccatctcactttgcctttgcttctgtcaaatttttcttgtttaattcaagtatctttgacatgttatcaggttatgctattccaccttccctcgtaatagggaagggaagtgaaagaaatgctatataagttagccccctaacgctttcaatcctaccgtcatatgtaatccgtaaaacaaggttctaccgagtaattcgccgatcaggattaacgcaaatccgctgaagctggtgagtgtagtgcgttttttcagtgctactagcaataagacaatatcgacaataatcaatccaaagtggataaaggtgatagtgagataatcaggtacgagatctaatgcagtgaatatcgccgtttttaccccttgtattagaatatgggcaaaagaaaaccccattacgagtaccttcataatgaggttatagagaaagtagagttgctttgccccttgtgccattaagcacgtagtgtagatataagcctactttctcatccactatcaccccgaatggtatctcaggcacgttttccgtagcccgcattcacaaggtttggaggtcaaatggataacccattatattacgttggcattgatattgccaaagctaaatttgatgttgccattaaattacaaaatggcaaacataagcataaagtgtttaaaaataatccggaaggatttcaatcacttatgcaatggctcaatacatttggtgaaacttttcactgcgtgatcgaagccaccaatatttatcacgaagctttggcagattttctgttccaacagcaaatcaccgttagcgtgattaaccctaaatgcagtgcaaatttcacgaaaaccgataatttacgctctaaaaccgacaaaatcgacgcaaaaatgcttgctgattatgccgatgaaaagcgtcataaattaccgatttatcagccaatttcacctgctcaacgggaattgttgcgtaaaaatcgccaacttgaccacctgaaaaaacagttggcacaagaaaaaacacggctaacgatgttgcttgacagcgattgcattgcttcaacacagcagatgattgccttcatcaaagcgcaaattaaggctttggaaaaaacaattaaacagtgcattaatgcagataatacattgaaaaacaatgtaaaattactttgcactattcctgctattggctttgcaaccgccgttcaactgattgcccatttaggtgatggcaatcgttttaaaaacgcgaaagcagccgccacttttgcaggtttaaccccgatgattaaaagttcgggaaaaagtttaaataccgttattggtatttcaaaaatcgggcaatccgacattcgtaaggcactcttttgccctgcaatgaactttgcctttggcagctacaaaaacagcgtatatcgctcgtttgtgctgcgattgcttgaatgtggcaaacctaaaatggtgattatcacggctttaatgcgtaaattagtcactattgcacaggctgttttgcaaaaacaaacagcatttaatttagacacatttatgaaataaaatttgttgtgtcttatggtatctaagagatattgatagttcaagtaggtgctaattgcagtggcaatcgccccaacgattgcaataccaaccaaggttttttgtaaatactcaccgcaacgtaccgcttgtaataagccgactgccaaagcagaaccagctaatacaaccgttaagaaaaacaatactggcgtatagacgctattccacgttggcacagttgggattaggtagagttttgccattgccccgataaaaattaaacctgaaatagcaaccactacacgccctaacggttgccacgctgttggtagtttgtgttcaatagatgaaacaaagctaacaagcggtaagcacgcacttggtggaaatcgccgtaattgtctaaaccaagattatcagtttctacatatttaatcactccatcttgaacgtgcatacgcaacgggcaacggctgtggcagtttacggtacaagcactccaaacaagtttttcattcgctgtagaagcggttggttttggattagcttttgcaattggaatttgaacagcacttgctgcaagtgccgccccacttaacgcagcaccacctttgagaaacgaacgtcgttctgccgaaaaatggctgctgtctgattgatgtttcatataatttcctcacaaaatagaaaattgacccgattaagtcgttcgtagggaatatagagatttccgttgatgaagttttgacgattatcaaattgctcaggaagtgagacgataacgctttaggttgagattattgcgttatttactatgttatatatcgattggtaatgtgtaacctgaaaatcaaacttgcaatttattatagctcggctatgctagtggcttattttgttttcatttttaagtagttatgtcacatcaccaccccgtcaaaggcgctattgcaattattaccgcaggctttttatttgcttgtgtcaatacgcttattcctaaattaacttccgtttcaacgattgatgccagtgttattgctctggtgcaataccttgttgcttttgtctttttaatgccaagtatggcaaatatgggcttttttcagtcgttgaggacgaagcattttggtatgcactgttttcgggtgtttttgtcggcaatcggtattcagtgttggacaatggctttagcttatcctattcccatttggcaggggattgcgttgttgatgacatcgcctctgtttgtgactattggctcagggctgtttttgaaagagaaggtggatacaaaacgctggattgcgaccttcttgggatttgtgggggcgatgattattttagaaccttggtcagaaaattttgagtgggtggtgttattgcctgttgctgccgcatttttctgggcgtgttattcgttgatggtgaaaaagctctctagcgaagattcgccaaccacaatggtagcctatctatttattttaattaccccatttaacttgttgatcgcattgacgaatttaagccctgaaggatttagtttgccatcatttagtgattttggtttcttaattttattgggattttttaccgcattggcacagcttgctgtcgctaaagcctatagtttggccgatgcttcttatattcaaccttttgattttattaagttgccattgaacgttttggcaggttggcttgtctttaactgggtgccgccaggtaagctatggttaggggcagcaattattattggggcgacgatgtatattacacacgccgaagcgaaacaatctcagcagaagtagatgatggcggaacaatctcaaacagagcaatcgacagcaaaaacaacggggagacgttgggtagctcgcgtaagcatttggctgatgaaaggcatattgggattgtgctttcctctttttttgctgatgtttgctattgattttgcaacaggctattgggtgcgagatcaaatttatattgatgtacgacaattaccccaacgggaatatgcgttggttctgggaaccgcaaaatattatccgtcaggctcgcctaatctttactacaaatatcgtttagatgcagctaaagcggtatttgagcataacaaggtcaattatttattagttagcggtgataataagaccgcttactataatgagcccaaaatgatgacccatgatttacgccaaatggggattccgtggcagcgaattagacaggattatgctggttataatacgttagattcgattattcgggcggataaagtgtttcaattacaaccctttatcatcatttctcagcagtttcattgtgaacgagccttattcattgcaaaatttcaccaaattgaagcggtctgttttacggcaaaatatccagatgctcactataaagtgcggattcgtgaattttttgcacgaagtgcgatggcggtgagtttattgttagggaaagaggcgacaaccttggaaccttcacagatgaagatgataaaaaataattaaattcctgagtataggcatggattgatttatatcacccttttctattttttccagttagtgatacaatctgaatttatttttattcactaattacattatgagtcgtcaaaagaaaagtcgtcgtcttaccgacattatgcctgcaagaaaggcagataaacccttacaacctaaagcaaaagtgtctaagggccgtaaaccaacacgttatgaattagatttagctgcgcgtgaggaaaagaaaaaacgtaaacataaaggtttgccgtcaggctctcgcactaatgaagggaatgagcaaaaacaaaaagtagagaaagaggtaaaagatccgcgtatcggtagccgtaaaaaagtgccgttaatggtggaatttgttaatcaaccagaaaaagaccgtgttattaaacctgtgccaattgaagttgagaaacctcgtttaagtccagagcaagagttagaacagttagaaaataatgaatgtttaaatcagctattagacgatttagaagcaggtaaaacattgtctgcacaagatcagaaatttgttgatgaatgtttagatcgcgttcacgaattaatgactgagttagggattcaagatgaagaagacgaatcagaagatttgctgcgtcaatttgaaacgatggacattaataatttccgttaaaaatgatgatgcgattttttctaattattttggcaattttgattgtgctgtcgatggcaggttacgcaatttccttatggcttaaattaaaaaaacagaaaaaacagttaaaagaggcacaacttaatcgctatcgttcgattatcgagagcattgatgtcattggacgagcaatgttagctgagcaatgtggtttttctgaaggggtattacgattaaaaccattacttgatgtactaggcaaaaaattaagtcaatatccagcaatgtggtcattgtatcaagtggttgaatcaatgccaattttagaggctcgtaaggaattaaaacgtaatgagcgaatgaggcttgacttagagcgtgaatcaaaagaggcagagttatctgagcagattaagcaagaacttcatcaattattaagcgaaatagagcaatttaaacaagagttaaaataacaatgacagacattatttgggatattaatcttatccaaaaatataatcaatcaggacctcgctatacctcttacccaacagcgttagagtttaatgagtcttataatgatgatgatttcaaagctgctgctgcacgttatcctaataagccactttcactttatgtgcatattccattttgccataaactctgttatttctgtgcttgtaataaaatcattacacgccaccagcataaagtcgatatttatctggattatttagaaaaagagattaaataccgtgcggatttatttaaggatagaacagtaactcaaatccactggggcggtggtacgccaacctatcttgatgaagaacagtcgctacgtctaatggcgatgttacgcaaacattttaacgtaatcgatgatgcggaaatcagtattgaaatggatccgcgagagattgagttggaaatgctcgatcatttgcgtgaaattgggtttaaccgaattagtatggggatccaagatttcaataaagaagttcagaagctggttaatcgtgagcaagatgaagagttcattttttccttaatgaaacgtgcaagagagctaggttttacctcaactaatattgatttgatctacggtttaccgaaacaaacagtagaaagttttatgtttaccttagaccgtgtgattgagttaaatcctgatcgaatgagcgtgtttaactatgctcatttaccaagtcgttttgcagcacaaatcaaaattaaagatgaaatgttgccagcccctgaaacgaagctcgaaattttacagaaaacgattgaaactttaggtaacgcaggttataaatttatcggtatggatcactttgcaaagcctaatgatgaattggcgattgctcaggcaaaaggggaattacaccgtaatttccaaggctatactacccaagaagatgcggatttgttaggcttaggggtatcggcaattagtttactgggggatagctacgctcaaaaccataaagagctgaaacagtattataccgaggtggaaatgcgtggtattgcattacacaaaggtttgagtatgactaaagatgactgtttacgccgtgatgtgatcaaagccctaatttgtaattttaatctagaatatgaccgctttgagcaagattatcagattgattttaatcagtactttgcagaggatttattattattagcaccgttagaaaaagatggtttgcttgatattggtgcaaagggtattgttgtttcgcctcgagggcgtttattgatcagaaatatctgtatgtgctttgatatttattcaagacaacaagcaaaacgacaacaattttcaagaatcatttaatgataatgtttgcaaataaggcagttacataggcttatttgtttacaaatgtgagtagaatcaaattatgaaaccatatcgctatagtttactttctattgctattgttgcagcttgctgtagtcaatatgtaatagcagatttgagaatgcaatgtttacaaggaattcctacttttcagggggatattatacaaggtgatcagactcttctacctgtgtatattgagtcagatcgtatggaaatgaattatccttctgaggcaacatattttggtgaagttagtgttaagcaaggtaatcgttctcttattacagaaaaagctaaggtagaacagaataacgaacagatgcgttttgcttatttaatcggtaaattcgattatcgggataatttcattaatgcgataggtaataatgcaaagattaatttgaacaactatgatgctcagttaggcagggtcgattaccatttagttgatcgacaaggaagaggtattgctgatgaagtcatgataactgaacaagcccgtcgaatgaaaaatgcaacttttacagcttgtttacctcatgataactcctgggctattgaagctaatgaaatggttcagcatgttgaagaggaatatgctgaagtatggcatgcgcgttttaaagtattgggtatacctattttctattctccttatttgcaatttccaataggggatcgtcgtcgttctggtttattggctccgagtgttggtcattcaagacgagatggttatatatatgcacagccaatatattggaatattgcttctaacatggatatgacatttgtaccaacatactattcaaaacgtggttggcagattgcacctgaactgcgttatttaacttatttaggagaaggtaaaatagccggtgaatatttaggtaaggatcgacttgaaaattgggcaaatcatagtaaatctcgttatatgctattttggcaacatgatatgagtttttttaataattggagattagctgttgattataaaagagttagtgatagtcggtacttttctgattttaattctatgtacgggaatagtactgatggttatgcggtacagcagtttaaattagggtactatcattcagattataatttttctatttcaggaaaaaaatttcagtcattttatgtagaaaatgatagcactacctatcatgtgttaccaaagattgagcttaattactataaaaataatttagtttctgatgttgatttcaagatgtttgggcagatggcgcattttgttaatcaaaataaactcatgccatcagcatggcgttttcatttagaacctagtttaaatgttccttttgttaaccggttaggaagtttagctttagaaactaagctatataccacctattatttacagaaactggggcaatcacaagtaataccgatagagtcacatatactccgggtattacctcaatttaagttggattttaaaactgtcttggaaaaggaaagacctttgtttaatgggttttcacaagtttttgagccaacaatacaatatttatatcgtccatataaaaatcaaggaaatattggagttagaaatcctaaatatttaggtttaggttatgactccgttttattgcagcaggattattactctttatttaatgagcgtagttatagtgggttggaccgcattgcctctgcgaatcaggttacgttaggcggtactacacgattttttagcgacaaaacaggaaaagaagtatttaactttagtgcaggacagattcaatatttatctccttcaagagttgatagtgagtcgttaaatagcgatacaaaacactcatcttcttggtcattagaatctaactggaaatttcattcaaactggaattggcatggaagttatcaatatgatacacgtctaaacgaaacatcgttagcaaatgtttcattacaatttaagcctaaaaataataacgtgattcagcttaattatcgttatgcaagcaaaaactatatagatcaaaatttaagtgataatcgctatgggcaggatattaagcaagttggaggtattatagcttggtcattgagcaataatttatcaatagtaatgagccactatcaagatattgctttaaaaaaaccggttgagagtcaattgggtttaaattatagcacttgttgttggagtgcaaaattttatacttctagacatttgatttcaactccgatggggaaaagcgatacgataaacgatttctactatgataatcgttttggtattaattttgaaattagatttaatggaaattatgaacataccgtgcctaagatgcttaaaaaaggaattctcccttatattgaagcgtttaatatcaattaaattttttagcctctttgatgaattaaaagaatcaatcaactaagattggttcttatgagtagtggcgaatattgatgaggtaataatgaaaaatccaaagcaatatgcccagcgttatgtcaattgggtattacgtttaggtaaagggaaatccgcattattgggtttgattattttagcggtgtttgcaatttttacacaaagcctattgagctggatatttactgggagcataaatactagcgatatttttcgttctattatttttggtctaacatcggctcctttcgtgatttatttttttaatctaattttagaaaaacttgaacgttctcgtattcgtttggagcaatcgttgaatgatctttccttgttacgtgaacaagatgctcgtttaaatgtagagttagaacaacaggctgaatttttacgttctttcttcgatgcttctccagatcttgttttttatcgtaatcaacatggggagtttctcggatgtaatagggcaatggaagttttaacgggacgttcagaaaaagagttacttcatcttactccaaaagatatttatcctaaagaaaccgctaaattaattctagatacagatagagatactctaattagtaatactggagttacttacgaacagtggattcgccattctaacaataaactttcctgctttgaaattcgtaaggtgccttactatgatagagtaaatgaatgtcactgtattatggggtttggaagagatattactgagcgtaaaagatatcaagaaatgattgaaaaaaatagccgagataagtcaacgttgatggctacaatcagtcatgagttacgaacacctctaaatggtatcattggcttaagccgtattttattagaaggtgaattatctgcacaacaaagagagtatttaaaaacaattaatattagtgctgtatcgttagggcatattttcagtgatattattgatttggaaaaaattgatagtcgccgcattgagttatttcgtagtgaagtagaattctcacaattaatcagtaacatcagccattttgctaatttaatggcagagcagaaaaaaattaaatttacaattcagtacgatgataatttacctgattttgtctgtgtagataatgctagacttagtcaaattttatggaatctagtgaataatgccgtcaaatttaccccttctgggggagagatttcactaaaagtggaacgtcgagatcatgatcattatgcttttattttgaaagattcagggattggcataaagaaaagtgagcagcgtaaaatttttgcaatgttttatcaatcagaaaattcccagggtaagaaagctcagggaagtggtattggtttagcaatatcgaaacgtatagctcgcttaatgggcggagatttaactgttgagagtgaattaaatcaaggttctgtttttactcttatcattcaagctgatgaagcaaatcattataaagaagtagcaataaacacacatgcactaaaagtattactggtagaggatattgaagtcaatattgtcgtcgcaaaagctatgttggataagtttgggtgtaatgttgatgttgcaatgacaggagcagaagcatttgagttatttgataaaaatagttatgacttaattttattagatattcagttgcctgatactacgggagtagaaatagcacaaaaattacgtcagaggtatgaggaaggagatgttgattatctgcctttattaattgctttgacagcaaatattatgcaaaccaaagctgaatatcagcaacaaggaatggatgatgttttacgtaaaccactatcattagaggctttatctgaatgcttaaatagatattttgatgaagggtttttagaggaatcctcggacgatgtagtcttgttagaaccgataagtaaaatgtcttttgatcctaaaatgcttcaagagttggttgaggtaatgggtaaaaagaatgtgttatcaacattagatctctttaccaacttaatgcctaattatttagagaatttgaatgattatttacaggattggcaagagactggtgatatacagaaacgtaaatgtgttgcggatgaagcgcataaaatcaagggggcattggcatctgtgggcttggttcatttacaacaaattgcgcaattagctcaaagtgataatggaaatgagtgggaaaataatctcgtttcttgggttgaattattgaaagattggagggaagattggaatgaagcggttaggtgggttagcaaaatagataatgtggaaaaattataggaatttctgcttttaatacaaattaatatgtaatatcaagcactggttagatttccattgcaaaaataaatacatattcactattaaatgaattgtttccatagaccggtaattgcgttagaataagactaattagtcttattctatttataaagttaatgaaacctgaaaacaaagcaaattttcaacgtattgtccgtgctacaggctattcaatgaaaggtctgaaaagtgcatatattcacgaagccgcatttcgtcaagaagtgtggctttctttttttctcattcctgtcggtttatatttaggcaatggggcaatcgaaaaaattctattagtcggttcggtgttgcttgtgttagtggctgagctactcaatagtgctgtagagtctgtggtggatcgtatcgggtctgaatatcatgaattatcaggtcgtgcgaaagatattggctctgccgctgtttttgttgcaatgcttatcacagggcttacttggttactgattttatgtttgtaatccagtgagtttttcacttatttctgtcaaaactaaaggagcttatatgaaatttaataaaactctacttgctttggctcttatgggagctactactgcgatggcgtatgaagcggataaaacctataagtttaccgtattacacgttaatgatacccacggtcatttctggaaaaatgataagggtgaatatggatttgctgctcaaaaaaccttgatcgacaaaatccgtaaggaagtggctgaaaaaggcggtgaggttgttttacttcatgcaggtgacttcaatacgggcgtacctgagtctgatatgcaaaatgcaagaccagatattgaaggcttgaatatgcttggttttgatgtggcagtgttgggtaatcacgagtttgacttccctctgcaagtgcttgatatgcaagaaaaatgggctaaattcccgttcatttctgcaaacgttatcaacaaaaaaacaaacaaacaccttgtaaaaccttatgttacgcttaataaaggtggcttgaaatttgcggtaatcggtttaactacagaagatacggcaaaacttggtaaccctgatgtgactgaaaatgtggtgtttaatgatccaattaaaaccgcaaaagaaacccttgcccaagtgaagaaaaccgaaaaaccagatgtaagtatcgcgcttacccatatgggctactactttgatgaacaacacggtatgaatgctccaggcgatgtatctcttgctcgtggcttggataaaggggcttttgacttgattatcggcggacatactcacgataccgtttgtgttgatgagaaaggcgtatttaaactcaaatatacaccaggtgaagagtgtaaacctgatttccaaaacggtacttggatcgttcaagcaggtgaatggggtaaattcttaggtcgtgctgattttgaatttaaaaatggtaaaacgaagctagtcaaatatgagcttatccctgtcaatcttaaacaaaaaattaagttagctgacggtaagagcgagtataaactgtatcaagaagagatccctgaagataaagctgtatttgagcacttgaaaaaatatcaagatgaaggcgataaattattgggtgtgaaagtcggtgaagtgaaaggtggtatccttgagggtgatcgtaaagttatccgtttccaccaaacgaatttaggtcgcttaattgctcaatcacaaatggaacgtgtgaaagcagatattggtattatgaactctggcggtatccgtgcttcaatcaatgaaggtgaggtcacttacaaaaatctgcttactgttcagccgttcggtaatatgattgcaaccgttgatttaacaggtaaagagttaattgattaccttaatgttgttgccctaaaagaagtcgatatgggagcgtatccacaatttgctggcgtgtctatggttgttgatcgtactgcaaaacaggtgtctgatgtgaaagtcggtggtaaacctcttgatctcaataaaacttacaaagtgtctgtacctgattactgtgcagcaggtggcgatggttatccaatcttgaaaaaacacccaagctatgtgaatacaggctttattgatgctgaaatgttgaaaaaatactttgaagaaaattcaccaattgatgcgtcaaaatatgatccaaaagatgatgtgatctttaaataaaaatttacaaaacaatactatgtaataatctgcgacaaagttatttttaactttgtcgcttttttaatgtaataattactgtaaagcaatgtttgtttttagaattgaatttaaaatcaatgtaaaatatagtttgctaaaaggatttagctggagatctttattcaaaagtattgtattatttcgacgatttgagaattattttcaagaagatttattttacctttacagagagcaaatctatgaaattcaaacacaatattctttatgcagcactgtttgctgttcctacctttgctattgctgaaacaagcaccctagcggaagtgaatgtaaatgcaacagcataattagaagataaccgtggtagttatcaatctcgccaaagcaatattgctaataaagacacgaccccgttaattgattcaccgcaaacagttaatgtagtgaatagtcagctgattgccgatcgccaaccgcaaagtttggatgaagccttagcgaccgtcagtggtatgacacaagccaatacccttggtggtttaatggatgcggtgttaaaacgtggttttggtgcaaaccgtgataacaccattttacgcaatggtgttgtcgctggtccttcacataacttttcagcaaccacagaacgcgttgaagtgttaaaaggtcctgcatctgtgctttatgggattcaagacccagatggtattatcaatgtagtgacgaaaaaaccacaacaagaagcgaaatatgtgctaggtgcttctatggggagtaataatgcttggggcgtaaatcttgatgccacaggtggcttaggtaatggctttgcctaccgttttattttcgaccaaaatgataaagattattggcgtaattttggtgaaattaagcgtactttatatgcaccatctctcgcttggcaaaatgataaaaccgaaattattgtaggttatgaacatcaagaatataccgatccattcgaccgtggtacttatattatcgctaacggtacaggcaaagggagtatcgtcaatattccaaaagaacgccgtttagacgagccatttaatgaagcagtgggtaaagttgatgctgtttctgtaaaagcaacacaaaaattaaatgatgcttggacactgaatacaacctatggctataccaaagatacctacaattattggcaagcgcgtgtaacggcaattaatttaaacagagagcgtgtcactcgccgtttagaaggtattcaaggctcagaacagcgtaaccacagtggaagtatcaatgcggttggcgaatttgccacggggaatgttgcacatcgtgtcgttgctggggtagatcttgctcgcactacattagatattgctcgttatcaaggcggtaatagcaatatttcattaagcaacccagtttataataccgccagcgtggcaaatatgccgctagcgaccaataatggtcatcaatttgcaacattaaaaacggctggtatttaccttcaagattctgcctatttaaccgataaattgattttatcgggtggtattcgttatgaatactacgatcaggaagcaggtcgtggcggttcaaccgttgcggatcgtttatatacagatggacacggcggtaaattcttatatcaaggtggtttagtctataaatttacgcctgactgggctgtttatggtaactatgcacaatctttccgcccacatttaagccgttcagcaatcactgaatcaggtttaaaaccagaacaaggcgagtcctttgaagtggggacaaaatatgaaaatgccttcttcagcaccaatttagcactgttcaatatcaataagaaaaatgtggcagttacggtaacggacgtgaatttttgttgaacgcaaaagttgagttttaatgtaacaagcggtgcgatcttggcggatttttacatgctgtagggacacactgcgtgtgtccgctaaaatgtcttcatatgtacggacacgttgcgtgtgtctgttagcgtgttcatatacggacacacgcagtgtgtccctacatttttctataagtttccaccgcttgtctctttctatctcagggcgacattcgcccttttgtcgtaaatgaattatgaacaactggcaaacagaagttaataacagcgtctattggttgataatcgcactcgcttgcgtgtctatcggactatatctaacaggtaaactcgttgggcgaactgctttcggacaaaaattttggcatatcaccaaaccttgctgggagaaatccaacaaaatcaaaacagtcggcttagtactattgttattattaatggtgttaatggaagttcgcattagcgtactcaacacctttttctacaacggcttgtacagctcgctacaaaaacagcaagctgatgccttctggttttttgcgatcattaatttaatgttggtgattgtgaaaattatccacgccatcatcaactatttcttacagcaagtctttgaaattcgttggttagaaaagctcaaccacgaaatgcttgaccgctggttagccaataaaaattactatctcgtgaagtatgaaaaagagttgcccgacaacatcgatcaacgtatcgaacaagacgcgacagagtttatcggtggaacgctagatgcggtgcgcagggtgattaatgcggtcgtttccaccattgaatttaccattattttgtggggactatcggggatcttggcgatcttcggcatagaaatcccgaaaggtgtagtgttctttatctatatttttattattgtcgctaccttgctttctgtaattattggtcgctcactgattgcgttgaacttcaataaagagaagctacaaggggattaccgttactcgctcattcgtgtgcgagataatgccgaaagtatcgccttttattcaggggaagctaaagaacgccgaaatttacaggcaaaattttctgcggtgattgataaccgttggaaaattgtccaaaaaatgttgggcttagacggctttaacacaggggtaacgcagattgcaatgattttaccgctgatgttgcagtcgcaacgcttttttgcagggcaagtaaccctaggtgatatgcaccaaacggtacaatctttcaaccgcttaatgcgtgctttgtcgtttttccgtctgttctatgatgaatttaccctgtatcaagcacgtttaaaccgtctgtacggtttctttactactcttgagcatctagacgaaatgccagtccaccagccatatccttgcaccacaggatttatgctgaaagattttggtatgaaagatgcaagcggtaatattctgatgaaaaatatcaacattgacataaaacgtggcgaagccttgctaattcaaggtgcttcaggcacaggcaaaacgtcgttgctgaaagcgttggcaggtatttatccttttgaaacctttggcacagccgagcgcccgtgtagcgaacagccgttgttcttaccacaacgcccatatatgccacagggaacattgcgagaagccatctgttatccacatattgaagcgacagacgagcagattaaacaagcaatggaaaaatgctgtttggataaatatacccacgcacttgatgacgacaacgactggcaactcaccctttctccaggtgaattacaacgggttgcttttgtgcgaattttactcagtaagcctgaattaattttccttgatgaaacaacctcagccctcgatgagccaacggagtctattctttatcgtactattcgggaagagttgccaaacagcacaattatcagtgtcggacaccgttgcaccttgtacccttatcataacaagcggattaatcttaatgcaggttgttgtggggtagaagagtgttgtatgaataaatagagaacagggcgaaagccctgtttttatgtgatagaaaattgaatggtttttcctgttttgtttatcatcataaacaacgcgtctagtgtaaatttttcaattttatgattaactacgtcagaaactcttggacgtgtaataccaagaatttttgcagcatctgcctgcttgagattatttgcattaatccattctgtcacattattcattaaagagattttagcttcaatgagagcttggcttgcttgttttaggcgttctgcttcttctggctcaaagccaagatcactgaaaatgttatctgtgggtaaagtaatatgacgaatttcagtatcaatcatgatttttctccttgatgaatagctttaaatctagctttaatgatttctatatctcgtttagcggttttttcactctttttctgaaaggcgtgtaaacaataaatcgcattatgatatttcgcaacatagaccaagcgataagcacccgattgctctttgattcgaatttcaaggattccactaccaagattctgcataggtttgaaatctcttggttctaacccttgctgaacaaggtcaagatcatgacctatttctcttttaatatgatcagggaataacctaatatcatctagggttgagcctacccatagaacaggcttacgcattatattcattttgtatcaaattttataccaaaagtaataaatatcaaggaaaataggattattgattcgttttatatttacacaagcagaaaaaacacatttttcgacgagcatcacaaaaataagagctgatcgaaacaagcgggcactttgcgtaaatttcttacaaattccgaaataacaggcgatttttcagaaaatctctgtataatagccaggttttatttcttcgcattctaagaggcggctatcaaaagtaatttgatgtgtgagattacttttgctagtcgcaatttttaggaaataaaacaacaataaatccaaaaattcataaggaacattcaaatgactccaatcgtcaaacaatttaaatacggtcagcataccgtaactttagaaacaggggctattgctcgtcaagcaacggcagcagtaatggcaagtatggacgacactacagtttttgttactgttgtggcaaaaaaagaggtgaatgaaggtcaagacttcttcccattaactgtggattatcaagagcgtacttacgcggcaggtcgtattccgggtggtttcttcaaacgtgaaggtcgtccatctgaaggcgaaaccttaatcgcgcgtttaattgaccgtccagttcgtccacttttccctgaaggtttcttcaacgaaattcaagtgattgcaacagtggtttctgttaatccacaaatcagcccagatttagtggcgatgatcggtgcttcagcagcattatctctatctggcgtgcctttcaacggtccaatcggtgcggctcgtgttggtttcattgataaccaatttgtgcttaacccaactacatcagaacaacgtttaagccgtttagatttagtagtggctggtacagacaaagcggtattaatggttgaatctgaagcagatattttaactgaagaacagatgttagcggcagtggtattcggtcacgagcaacaacaagttgtgattgaaaacatcaaagaatttgtgaaagaagcaggcaaaccacgttgggactgggttgctccagagccaaatacggatttaatcaataaagttaaagcattagcagaagttcgtcttggcgatgcttaccgtatcactgaaaaacaagcacgttatgaacaaattgacgcaatcaaagcggacgttatcgctcaattaactgcagaagatgaaaccatttcaagcggcaagattgtagatattattaccgcattagaaagccaaatcgtgcgtagccgtattatcgcaggcgaaccacgcattgacggtcgtacagtggataccgtgcgtgcattagatatttgcacaggcgttttacctcgtacgcacggttcagcgttgtttactcgcggtgaaacacaagcattagcggttgcgacattagggacagagcgtgatgcacaaattattgacgaattaacaggcgaaaaatcagatcgcttcttattccactacaacttccctccatattcagtaggtgaaacaggtcgtatcggttcgccgaaacgtcgtgaaatcggtcacggtcgtttagcgaaacgtggcgtgttagcagtaatgccaacggcagaagagttcccatatgttgtgcgtgtggtttctgaaattaccgagtcaaacggttcttcatcaatggcttctgtatgtggtgcttctcttgcgttaatggacgcaggtgtaccaatcaaagcggctgttgctggtatcgcaatgggcttagtgaaagaagaagagaaatttgtggtactttcagacattttaggtgatgaagaccacttaggtgatatggactttaaagtagcaggtactcgtgaaggtgtaactgcattacaaatggacatcaaaattgaagggatcacccctgaaattatgcgtatcgcattaaatcaagcaaaaggtgcgcgtatgtacattttaggcgtaatggaacaagcgatccctgcaccacgttcagaaatttctgacttcgcacctcgtattcatacaatgaagatcgatccgaagaaaatcaaagatgtgatcggtaaaggtggtgcgacaattcgtgcattaaccgaagaaaccggcacatcaatcgacattgatgatgacggaacagtgaaaattgcggcaacagacaacaacgccgcgaaacgtgtgatggaacgtatcgaagagatcgttgcagaagtcgaagtgaatgtaatctacaaaggtaaagtaactcgtgtggttgatttcggtgcattcgtgtctatccttggcggtaaagaaggtttagtgcatatttctcaaatcacggaagctcgtgtagaacgtgttgcggattacttatctgttggtcaagaagttcaggtgaaagtggtagaaatcgatcgtcaaggtcgtatccgcttaactatgaaagatctgaatggtgatgcaactgcaacagaaattgttgaagaaattcaagaattagcagaataatcacatctatctcttcctcgaacaggggaagggatcttcattttaagaatgataaatacctaaggttttattaatgccacaacgttttaagttgtttaattttcgtttttgctggttagttttggtaatgatttttttgacaggctgtgtgaacagagtgtcagatatgattgccccgacaaaattacctttatcggaactcaatcctcagttacgttttgaacaggaagtaatgcttgttcgtttaacgcaagtgttgcaagaagcgaaattaagccaagctgaacgtgccgaattacattttgaaagaggcgttatttacgacagtttaggactttggtcgttggctcgttatgattttacgcaagcggttgaatatgcacctaaaatggcagctgcctataattatttagggttatatttattgcttgaagatgattatgacagttctatagatgcttttaatgccgtgttggaactcgatccaaattatgattatacccgtttaaatcgtggtttagcattttactatagtggtcgttattctgaggcagaacgtgatttattgcgtttctataaagcagataagtccgatccttaccgtgtattatggttatatttcaatgagttagaattaaacccaagtgatgcaaaagcaaatttgttaaaacgtgccaagcatttgtcaaaagacttttgggggacacatttagtgtcttacttgctaggggattttactcttgaacaacttcgtttaaaaatgattgctcaagctgaaccgaatacggtagcttatgcagagattttaaccgaaacatatttttatcttgcaaaacaaacactcaaaatgaatcagcttgaagaggctaaaagccttttccgtctagctattgcaaatcaagtatataactttgttgagtatcgttttgcgttgtttgaattagctcaattacatcaaagagcaaaacaaacagatcccgttgttgttgggaaaaattaggacgatttaagcggtaggtttcgcaaaattttttgcaaatcaaaccgcttacactgtgtgacaagttatataaagcattggtttgctttctatttatttttcttacctaaaaagctcaacaatataatttttattttttagtgaaatgttggattgatccgctccccatcttttctaaagatgggttaccaaattctgataaatggtgctctgtagggacacactgtgtgtgtccgattgcctaatttttatgtgaatttgatagcttgcggacacacacacagtgtgtccctacaatgaacctgataaccttgcttttctaaagagggggatcagttttgtggaaaaacacattccctaaaataaccaattttggaattttatgactgaaacaactttaactttcgccgatttaggcttaccacaatctatccttaacgctgtaaatgaaatgggttttgtaaccccatcaccgatccagcaagcctgtattccacaccttttaaatggtcgtgatgtgttaggtatggcacaaacaggaagtggtaaaacagcggcattctctttgcctattttggctcaaattgatccagaacagcgtcacccacaaatgttggtgatggcgccaacccgtgaattagcaatccaagtggcagatgcttgtgagcagttcagcaaaaatatgaaaggtattcgcacggtcacgatttatggtggtcagcgttatgatattcaaatccgtgctttaaaaaatggtgcgcaagttgtggtaggaacgcctgggcgtattcttgaccatattcgccgtggcaccttagatctttctatgttgaaagcgattgtattagatgaagcagacgaaatgttgcgtatgggctttatcgaagacgttgaaacggttatggcggaattacctgaagatcaccaaacggcacttttctctgccacaatgccagagccaattcgccgtattaccaagcgttttatgaaagatccgcaagaggttaaaattcaggcaacccaacgttctgcaccagatattgcacaaagctactggttagtgaacggcttccgtaaaaatgatgcgttattgcgtttcttagaagtagaagagtttgatgcggcgattatttttactcgtaccaaaacgggcaccattgatattgctgaactctgtgagcgtaatggctatcgtgcagccgcattaaacggtgatatgacccaacaagcgcgtgaacaagcattggaaaaactaaaatcaggtcgtttagatgtgattgtggcaacggacgtggcggctcgtggtatcgacattgagcgtatcagtttggtagtaaactacgacattccacttgacgcagaatcttatgttcaccgtatcggtcgtacaggtcgtgctggtcgttcaggtcgtgcattattatttgtagagccgcgtgaacgtcgtttattgaaaaacattgaacacttaatcaaaaagccgattgatgaagtgccagtaccaaatcacgaaattttaatggaaaaacgtcgtgagaaatttaaagcacgcatttcattacaattagaacatcacgatttagagctttatcgtgaattattagaagatctattcacggcagaccaagatcacgaagaattagctgcagcaatgatgatgttgttgcaagaaaaacaaaaacttattcttccgccagatcctgaaattcgcccttctcgtgctgagcgtggaaaaggacgtgaaaatccacgttctgcggaacgtcgtggtggcggtcgtgagcatcgtgataacaacggcgttacgatggatctctatcgtatcgaacttggtcgtgaagatggtgttgaagtgcgtcacattgttggagcgattgccaacgagggtgatattaacagccgttatatcggacatatcaagttacacgataaatactcaaccattgaattaccacagggtatgccgaaacatttagtgcaacatttcgcacagaaagcacgagtgttaagcaaaccaatgcaaatgtctttcttaggtcctgtgggcagtacaactaatgctaactcttatgaagataaaggcggacgtggtaaaggtcgtggagaccgtcacgaacgaggtggcagagagggccgccgtgaagaacgtggctttaaagaccgaaaagaaggtggatttaaagaaaaacgttttaacgagcgtggtcgtcgataatctgatgcgtagggacacactgcgtgtgtccgctacttgtacctaaaattgtgatttatggacacacgcagtgtgtccctaccattttaattaaattatgtttatccaacccacccaatcccattgcgatttaaccttaaccgaacaggatgtttactttatgcaatacgccttatcccttgcagataaagccgaagcagaaggggaaattcccgttggggcagtgttggtcgataaaacaggcaatattatcggagaggggtggaaccgtgcaattattctctctgatccaaccgctcacgcagaaattcaggcaatccgaatggcaggacagcaattacaaaactatcgcctattagatacaatcctttatgtgaccctagagccttgtacaatgtgtgctggagctattttacatagccgtattggacgtttagtttttggagcatcggattacaaaacaggggcgctaggctctcgctttcatctttttgaagactataaaatgaaccattttctgcaaattcgaggtggcgtgatggctgatgagtgtagccaaaaaatcagtgctttttttagaaagagaagggaagagcagaaaaatcagcatgttaactacaactcatcaaaatagctctgtccccacgtcttttcagctagttgcaacaaattcgcaaaatcttgataagaaggaaacgcttggtcagcgatattatgttgctcactgatcaacttttgacgaagttcttcataccattgcaacaaccccaagggtagcggcgatttcgcccgtcgcccaagccaaaataacccttgaaatgggatactcaatgcaaacaacgccgttaaggtcgcattggctagaatggattgttcaggatcgtggaaaaagtattgccaaactaacgcaaaacaagcaaaagcaggcataaaatgtgacgaaaatttaactaagcggattaaacgataatcgggcataaacagtccgagtttcttctgatttgggaaggtattgaggtaacgctgtcctgcttgcaaggtgtgatacataatttgcctttatcgttaaataattcaagttacattctactcatctctacaaaatctacaatagcgaattatcacaacagttgctatactttccatatagttacgcagaatgatgtagcaaatgctataccatactgtattatgttgaattttcaccacattaatttaaggaagtcaaatgccgattaaatttccaagtttgttacaagatagttggaattttatccgtaatcaagggagctttacgcttacgggtaccgcattattaattttattacaattatccaccatttttctctttcctagagtagaaatacaggcaggaaatacatcaaatcaggagatgttagctttactagcctcacaacttgcccctgccattctttctgctctgattagtatgtttattaatatcctattgattttaaacattaaatctatcaacagtggcacttatcaacatttcagccaaaatatcggggcaactctcaaagccttttttccaatcattttgttgtcgatctttatggtaatgccactttcaatcggtatctcatttggtggcaccgtcgggcaacaaggcaatcttgctataatgatcttactgcttatggcaacaggtatctatttgtttatcaaacttagccttgtcgtctatgtccatttacttgaagccccacaaggcattatgcaaaccttacgttttacttggggattaagtcgaggcagaatggtgccgcttttcctattttgtatcttaagttatttctttcctagcttgttaggttcattaatcggtagaattggcggagatgtcgggattattctttcacaagtggtcggagcctttatcagcttatttgttgttgtatttagtttccgtttctatcaagtgtatcgccaataggattgacaatgaaacagttacttgaatttattccactgatcctcttttttgtcgtctataaaacctatggcgtacaagaagcagcattagtgctagttgccgctaccgtggttcaatttatcgctttacagttgctttataaaaaaatcgaaaaaaatcaatggattatgggaatagcggtcgttttcttcggcttacttaccgcttactttaacgacctggcattccttaaatggaaagtcaccattgtcaatgccatttttgcggtagcgttactcgttagccaatacgtattcaaaaagcctcttatccaaatgttacttggcaaagaactcaaactgccacaaaacgtatgggaaaagctcaatttaggttgggcaggctttttcatcttctgtatgatcatcaacatcatcatcagtgagttcttctctgacgatgcttgggcaaatttcaaggtgttcggtttaacaggattaagcctcattgccgttatcggcacaggcttatatctctacccccacctaaaacaactagaacaaaaagaggaaaataatggaaacacaaactaaacgccagcctgaaggcacattaattttacgcaccctcgcaatgccatcagacaccaacgccaacggcgatatttttggtggttggataatgtcacaaatggatatgggcggtgcgattttagcaaaagagctagttaaaggcagagtagtgactgtttcagtagataaaatgtcgttcttactgcctgtatcagtcggtgatgtggtttgctgttacggcaaatgcaccaaagtcggacgcacctcacttcaaatcaaagtcgaagtatggatcaaaaaagtgtatgaaggaatgagagaacgccactgtgtcaccgaagcactctttacctttgttgctgtagatagcaacggcaaacctcgtgttatcccacgagaaaacaacccagatcttgaccaagccttagctttaattgaaccttaatggaggacattatgtactatgtaatttttgctcaagacataccaaacacccttgaaaaacgtttagccgtgcgtggaaaacacctcgaacgtctaaaacaacttcaagccgaagatcgccttttaaccgcaggtccaaacccagcgattgatgatgaaaacccaggtgaagcaggttttacaggttcaactgttattgcaaaattcaattcacttgaagaagcaaaacagtgggcaagccaagatccttatgtggaagcaggggtttatggcgaagtgattgtgaagccgtttaaaaaggtgttttagtttaattaatatagattcaatgcagataagaaaccaagtaatgttattatttgggtgcttatctaattgagatatagtcgataaacagttgctatggcacatcaaaatatatggtggaacggattttagaagataccgttaaggctaatccacaattctctgcagcggtattacgttatttcaatccagttggagctcacccaagtgatttgaaaagcgtgggaaaagttaggctggaaagctgaatgtgatttgccacagatgatgaaagatatgtggcattggcaaaagaacaatccgaatgggtatcgttgatgtaaaattatcttatccgcaggctacaaaactcaacttatttatttgcccctatcccctgataccaaggactaaagcggtttcttgcggtggaaatgttgtaattatctgaataaaaatcgacttggatcattcccacttgagcagtattaagccacttcacttgatactgctcaagccgttgaataacttgactatttggcattttccacgggttccaacgcccagccgaaataatcgcccaagtgggttggatgtgagctaacaaagtttggctggtactggttttactgccgtggtgtcctacttgaagaaaatcgatcttaccgatctggcttgcatattgtcgttcttccgcaatcccactatccccagtaagaagcaatctatattgccctatcgacactcgtaatacacaagagtgttcatttttagctcgctcgctcagttgtaaaggataaatcgcttcaaggtgcattgtgctgaactgccactgattgcctgctatacaaggctcggcgacttggttactataatgatttttacccgaaaggatcaaccgtgcatttgggtaggcttgtagtaatggcaaaacgcccccagcgtgatcgttatcatcgtggctaacaaaaatagcttcgaccactatcccttcacggcgtaaatagggcagtatttccaattccgccattgtaccaccttgccacgcaacgcctgtatcatagagaatggctttctgtttaccttggtgttgataaatcaatcccattgccaacccttgccccacatcaaaattcacccattttacaagtggtggtttaagtgtatcttttacaaaatgaaatccgatccacaatgctaaaggcaatgccactgttgctaacccataatagagagaaaaacgttgctgaaaaacaccatataatcctattataatcaatagattaaggcatattaatccccattgttgatcgacacttaaatagagccaatgatgggaaaatggctcaatccaatcaatcccccactctgcaagttgatggcaaagccaccaagtttgaaataggttatctgttaataaactaaataaaatcaatgggataagaataaagctataaagtggaacaatgatcaaattggctaacaaagcgaaaggtgatgtaccatcaaaaaaactgagttgaataggcgagaacactagccaaatgcctaactgcagatgaaacaactctaacagcaacttcatcactcgattttgcatatttttgacaaaatcaaaccgcttgagtggaaaagcctgataccaaataattagactagcaacagccaaaacagagagccaaaagctatcggaaagtaacgtcagcggatcaaagacgactaatagcaccacaccacgaagccataactgccaaggcgtataatgacgacgagcatattgcaccagcaaaaccaatgaaatcgccaccattgcccgtaccgttggaatttggaagcctgccaaaaaactatatcccaacgccacacaccaccctactccccttgcaaaatacaaggacaaccccaccgatttcagataacgaaatcgcaataataaccactgcccagctttcgccgtccaaaaggctaacagataaaccagaacaatatgcgagcctgaaatggcaatcaaatgagcagtggttgtttgctgaaagatctcccaatggctttgacttaaccaagcccgttcaccaaaagcaagggcaagcagtaacccttgcgttgcaaaaggggcggtctgttctcgcatacgatcaagccaaattgcacgcaagccttgttgttcgttcacttttactgcttttttgaccgtagctgttgctgagatatgttgagccacataccatttttgtcgatcaaaattgccatcatttaagcgagcggacaaaggcttcaatgccagttccgcgttataacttgcttccagtatcaatggctcatcagcttgccaattgacataaacatagtccccattagcacgctctacaacggcagtttgatattcttgctgttttaaaatttgcttcactaacacccgctcttgcaccttaacagcggtctgttcctgatgtttttttgcaagttgcataatctgggcgtaactcaccgctaacacaccacccaacagcaagatccccaatttcccacgccatactccccataatgcaagggcaagagaaaataccaccacatagccaagccacgaagcaggcagaacaatcaacggcaataaaccgaaaaagagcattaaacagacacgatcaatagacatcatcaacatacctaatcaaagagattacagtatgccaatgatgaaaagagagaaaagtagaaaaataatgtttttcgacagggatcacaaaaataaatattggtatatcaaattgtttgtagttatgatttttaacacgatatctttttaatttagattaaaaagttagataagaaatgcaaataacttgacaaatttttcaaagaattttcaaaattgagaagtagttcaaattttaactacaaggagtgtggtagtattagctcgaaagctgagatggctcagttattactaaacacaacaaggagtatattatgtataaacatattttagttgccgtagatctctctgaagaaagccttgtattattgcgtaaaggtgcgagtcttgctgaaaaatgtaatgcaaaattatccgttatccacgttgatgtgaacttttcggatctctacactgggttgattgatattaatatgtcgtctgttcaagattctgtgtcagaagaaacgatcaaagcattagaggaactctctggtaaaattacttaccctgttactgaacgtttaaatggtagtggtgattttagtcaagtgctggaagaagcggtagaggagtatcaagtggacttattggtcactggtcatcaccaggatttttggagcaaatttatgtcttctactcgtcaagtgatgaacagtgtaacggtagatatgctcgttgttcctttagcaagtgaataactcaagctattgattggtaaataaaacgtgaaaaaagaccgcttgtgtagctgagttatcgcattcagttactctggcggtctattttttgacttaatgtcaataatttatgcagtaaaaaatacaagtattgaaaaaaatgtgtaaaataggtgggtcaattactaatatactttagtaaaaacatagatatacagttttttatatccatttgagtgactttaatgaaaacaacttcagagattagacaagcctttttggagtttttccaaagcaaagggcatacgattgtgccaagtagctcgcttgtacctgaaaatgatccaaccttgcttttcacgaatgcaggaatgaaccagtttaaagatgtgttcttaggattagacaagcgtagttataacagagcaaccagctctcaacgctgtgtgcgtgctggcggtaagcataatgaccttgagaatgtaggttataccgctcgtcaccataccttttttgagatgttaggtaactttagttttggtgattattttaaacccgatgcgattgcatttgcgtgggaatttttaacatcaccgcagtggttagcgttaccaaaagagaaattgtgggtgacagtctatgaaacagacgatgaagcctatgatatttggaatagagagattggtgtgcctgctgagcgtattgtgcgtattggtgataataaaggcgcgccttatgcgtcagataacttctggcaaatgggtgatacgggtccttgtggtccttgtactgagatcttctacgatcacggtgaccatatttggggaggtccaccaggctcaacagaagaagatggcgaccgtttcattgaagtatggaacgtggtctttatgcagtttaatcgtcaagcagatggtactttaaagaaattacctaagccgtcggtagatacgggtatgggtttagagcgtatcagtgcggtgttgcaacacgttaattcaaactacgaaatcgacattttccaagcgttaatcaaagagattgcttctttgttaaatgtgacagatttagacaataaatcgttacgcgtaattgcagatcatattcgttcttgtgcgtatttgatcgctgatggtgtgatgccgtcaaatgaaggtcgtggttatgtgttgcgtcgtattattcgtcgtgcggtgcgtcacggaaacattcttggtgcgaaatcagcgttcttctatcaattagtgccaacccttgcaaaagcaatggggcaggctggcgagattttgacgcagaaacaagcgcatattcagaaagcgttaaaagcagaagaagatcagtttgcacgtacccttgagcgtggtttggcgttattagaagatgcgttagccaaagtagagaataaggttttatcaggtgaagtggcatttaaactttacgatacttatggtttcccactggatttaacggcagatgtttgccgtgaacgtagtattaccattgatgaagctggctttgagcgtgaaatgcaagctcaacgtgcaagagcgcaggcaagcagtaattttggtacagattacaataatgtgattaaagttaatggctcaacggagttcaacggctatgaggtcacagaatgtgaagcgactgtcgttgcgttatttagcaatggtaaggcggttgaagctattcaatcgggggaaaatgcagtcgttgtcttggatcgtaccgctttctatggagagtcgggcggtcaggttggtgatagcggtgtgattgcttcagaaatttgcaattttgaagtcaatgatacgcaaaaatatggtcaagtctttgggcatattggtcaattagcttcaggcactttatcagtcggcgataaggtgaaagcagaagtgaatacgacacgtcgtcacgctattaccttaaaccatagtgcgacccacttattacattcggctcttcgtcaagtgttaggtgatcacgttgcacaaaaaggttctcttgtgtcagaaaattcacttcgttttgacttttctcaaggtgaagcgatttcaaaagctgacttagaagagattgagcgtattattaatacgaaaattcgtgaaaacattgtagttacaactgaagtaatggatcttgaatcagcgaagcaaaaaggtgcgatggcactgttcggtgagaaatatggagatagagttcgcgttgtagatatgacagcagcgttttctgtagaactttgtggtggtactcacgttaaacaaacaggtgagattggcttattcaaagtggtatctgaaggtgcggttgccgcaggtgttcgccgtattgaagcggtgacaggcgaaaatgcaatcggcttattacatcagcaacaacaaattcttaaccaaagtgctgagttattaaaagcagatacggcaagccttgttgagaaaatccagcagctacaagagaaaagcaagaaagtagaaaaagagctacaacagctcaaagataaacttgcagctcaagctggtggagaattagcaaaacaagctcaacaaatcaacggggttaatgtggttgttcaacgtttagaaaatgttgatgcaaaagcattaagaacgatggtcgatgacttgaaaaatcaactaggttcagcggtgattgtctttgcaacacaaactgatgaaaaagttaatttgatcgtaggtgtaacaaaagatcttacagacaaagtaaatgcaggcgagcttgttgggttaatggctcaagaagttggcggtaaaggcggtggtagagctgatatggcaatggcaggcggtagccaaccagaaaatataacccaagccctcaatgttgcgacgaattggattcaagcaaaactctaattataagaggtaagttagaatgactttggcttgccttgattaaatctaaaaggagagatagttatgcttattctaacccgtaagattggcgaaagtttattgatcggtgatgatgtagaaattactgtcctaagtattcgtggtagtcaggttaaattaggggtgaaagcacctaaggaaatttcggttcaccgtgaagaaatttatcaaagaatcaaagcgttagcagatgagaatccttcagaataaggtatattgatatttactgaagttcttgatctaacgtaatgtgaatttgatccttgaaccaaatgtcacaaacagataaattgaaacgcagtgttcaattttttgaaaaaatttgtgcaaaacagaccgcttacttaaggtaggcggtttactttatctaaatatattaaggatttttctatgaaagtgattattcctgtcgcaggtcttggtactcgtatgcttcctgcaaccaaagcaatcccaaaagaaatgctaaccattgcagacaaaccgttgattcaatatattgtaaacgagtgtgtggctgcaggagtaagagaaattgtgcttgtcactcattcatctaaaaacgctatcgaaaaccactttgatacatcgtttgaactcgaaacaatgttagaaaaacgagtgaaacgtcagctattagatgaagtgcgttcgattgtacctaaagatgtgaccttgatgcacgttcgtcaggggcaagcgaaagggttaggtcacgcggtattatgtggtcgagctgtggtaggaaatgagccttttgcagtggtattgcctgatgtgttattggcagattttactgcagatcaaaaaacagaaaacttagcagcaatgattcaacgtttcaaagaaacaggcaaaagccaaattatggttgcacctgtggcgaaagaaaatgtgagtaactatggtattgtagattgccaaggtgcagaattacaacctgcaggtacagcgaagattgctaacattattgaaaaaccaagtattgaagaagctccgtctaattttgccgttgtgggacgttatgtcttctctgcagaaatttgggatttacttgccaaaacaccggtcggtgtgggtgatgaaattcaattaaccgatgcgattgatatgttgattgaacaacaagaggtggaagcctttcatatgacaggtaaaaccttcgactgtggtgacaaattaggctatatggaagcctttgtagaatacagtttgaaccacgataaatttggtggtgaatttaaagattatttgaaaaaattatcgaagtcgctgtaattaaatttatataaaatgtagggacacactgcgtgtgtccgttcaaaatttttattaataatggttggtggacacacgcagtgtgtccctacgctaacaaggagcaaatgtgatcgtcaaaaaaatagcacaagcggtaggttttgggcttttttgtgctggcttgattctttatgttgccccttggttaaacaaaagcactcaaacagagattatcagctttcacgatgcggtaagaattgcgtcacctgcggtagtcaatgtttataatcaggcctttgattctacccattctgatacaggggagttacaagtaaacaatttgggatcgggcgtgattatgacctcaacgggttatattttaacgaataaacacgttatccaaaatgcagatcaaattttagtggcactgcaatcggggacgatttcgagtgctacattggtaggatctgacaccttaactgatcttgctgttctcaaaattcaagcagaaaacttgcctacaattcctcaaaattcaaaacgcgtggctaaaatcggtgatgtggttttagcaattggcaatccgttaaatttagggcagagtattacgcaaggcattattagtgcaacggggcgcaatgcattatctgaaatgggtcggcaaaactttattcaaactgacgtttctattaataagggtaattcaggcggagctttggtaaatacggctggtgagttgattggcattaacactttaagtttaggaaaaaacagtgatgaattggcagaaggattgaattttgcgattccgatttccttagcaaataaggtgatggaaaaaattattcgtgacgggcgtgttattcgaggctattttggtgttaatagctcgttgtactatacggctaaacagctaggagtcggtgaaaaagggatcttaattactacagtagctgaaggtggacctgcggataaagcagggattttagctggtgatttgattttacgtttaaatgatacagaagcccaaactccagctcaaatgatggaattgattgcagaaatgaaaccaaatagtaaggtaaaggtattaatttctcgtcaaggcatacagaaagaagttgaagtggttattggtgaatttccagagttataaaggataaatatgggtattgtaattacagttgatgggccaagtggtgcaggaaaaggaaccttgtgtcacgcccttgcagagaaattaggctttgattttttagattcaggagcaatttaccgtattttagcattggctgcagtaaaacaggggattgcctttgagaatgaaacggctcttgcgcagcttgggcgaaatcttaatgtgaaatttgtgcctgagaataatgaaattcaggtcattttggacggtgaaaacgttggcgatcaaattcgtacggcacaagcgggtcaaaatgcgtcaaaaattgcggtttatcctcaagtgcgtgaggctttgttacaacgtcagagagattttagaagtcctaaaggattaattgccgatgggcgagatatggggactgtcgtctttccagaagctgaaattaagttctttttagatgcaagtgcagaagaacgcacaaaaagacgtgtaaaacagttgcaagaaaagggatttaatgctaactttgatgagattttagccgagataaaagagcgtgattttcgggacagaaatcgccctgttgcacctcttgttccagctaaagatgcgatgattttagattcaacgcatttatccattgaggaagttattcaacaagcattggattatattgctcaaaaattgtaattttgtttgcttaacaaaggattgttaagtcgttatccctaaccccatttagatggatgctaaatggacgttttattttatttaagaagattaattatgactgaatcttttgctcaactatttgaagaatcactaaaaggtcaagaaacccgtttaggttctattgttaaaggtactgtagttgcaattcaaaaaggctatgtacttgtagatgctggtttaaaatcagaatcagcgatccctgctgaagagtttttcaacgcacaaggtgaattagaagttcaagttggtgatgttgttgatgttgctcttgatgcagtagaagacggtttcggtgagaccaaactttctcgtgaaaaagcgaaacgtaacgagtcttgggctgcgttagagaaagccttcgaagaacaagcaaccgttgttggttttgtaaacggtaaagtaaaaggtggcttcactgttgagttaaacggtgttcgtgcattcttaccaggttcattagttgatacccgtccagttcgtgattctttaaatcttgaaggtcaaactttagaacttaaagtaatcaaattagaccaaaaacgtaacaacgttgtggtatctcgtcgtgcagtaatcgaaacaacaagctctgctgatcgtgaagaagtattagcgaacttagttgaaggttctgaagtgaaaggtactgtgaagaacttaactgactacggtgcattcgtagatttaggcggtgttgatggcttattacacatcacagatatggcgtggaaacgtgttaaacacccaagtgaagttgttgcagtgggtcaagaagtcactgttaaagtacttaaattcgacaaagagaaaacgcgtgtatcattaggcttaaaacaattaggtcaagatccgtgggcagctattgcacaaaaccacccagtaaacagcaaattatctggtaaagtaactaacttaacagactacggctgtttcgttgaaattttagacggcgttgaaggtttagttcacgtttcagaaatggactggacaaacaaaaacattcacccatctaaagtggtaaacgtaggtgatgtggttgaagtaatggtacttgaagttgatgaagaacgtcgtcgtatttctttaggtttgaaacaatgtaaagcaaacccttgggaacacttcgctgaaactcacaacaaaaacgataaagtaaaaggtaaaatcaaatcaatcactgatttcggtatctttatcggtttagaaggtggcattgacggtttagttcatttatctgacatttcttggaatatggctggcgaagaagctgttcgtaactacaaaaaaggtgacgaagtagaaactgttgtattacaagttgatgcagtgaaagagcgtatctctttaggtatcaaacaattagaaactgatccattcacaaacttcgttgaaggcactaaaaaaggtgcaatcgtgaaaggtaaagcggttgaagttgatgctaaaggcgttaaagttgaattagcagatggtgtagaaggttatgttcgtgcagctgaagcaacccgtgatcgtgtagaagacatcacaacagttatctctgtaggtgacgaaatcgaagcgaaatacacaggtgttgatcgtaaagctcgcattgtaaacctttctattcgtgcgaaagacgaagctgaagaatcagcagcacttgcacaagtgaataagcaagaagaagctattccaagtgcaatggctgaagcattcaaagcagcaaaaggcgagtaatttactctcttcgtaagcggatatgtgaaagcatatccgcttcacctatcgcataaggagaaaatatgactaaatcggaattaatagcaaatctcgtagctcaatatccctctctatcagttaaatctgttgatgaaagtgtaaaagaaattttagaacagattatggggtcgttagaacaaggtgaacgcattgaagtaagaggctttggcagtttttctctacattatcgtcagcctcgtgttggacgtaatccaaaaacaggcgaaagcgttaagttagatgctaagtatgttccgcacttcaaagcaggcaaagaactgaaagaacgtgttgatttagcctaattctctgaaagcgacactgtggggtgtcgtttttttataaactaatgtaataatggagatacgcagatgaaatatattttgggcatcattattgtgcttgctatcattcttgttgccgtgactattggggcaaataacgatcagcttattacattcaactacatcatcgcaaaaagcgaattacgtttatctagccttgttgccattttgtttggatttggtttaattttaggttggttaatcacgggatttttctatttaaaagtgaaattacaaaatattgccttaaatcgccgtgtaaaacgccaagctcaacaaattagcgaacttactttaccaaaggctgaataatgctggaattgttgttccttttgttgcctattgcagccttgtatggctggtatatggggcaacgtagtgcaaaaaaggatcaagatgcaattaataacaaattttcccgtgactatgtcacgggtttgaactttcttttatctaatcagcaggaaaaggcggttgatcttttcctttctatgctacaaaagcaggagtctgagaaccagatttcaacagaatcacaatttgaagccgaaattactctaggcaatttattccgatcaagaggggaagttgatagagctttgcggattcatcaagggattgaaaacagtcctcactattcctttgaacaaaaattactagcaaaacaacaacttgccaaagattttatggctgcaggtttttatgatcgggcagaaaattactatattaccttgcttgatgaacctgagtttgcagtcaattcattaagtcagcttgctgtgatttatcacaaaacacgagaatggaaaagagcgattaatgtcgctgaaaaaaggcttagaatagagcctgaaatggataagatccctttatctcactattattgtgaatatgcacaagcggtcagatcggacgatgaaaaagcatttttaacagcattacaaaaagccctttcttacgttcctcactgtgcaagagcctcaatactcttcggggattttttctttgaaaaacaagaaatgcgaacggcattacgctattttgaagcggtattagaacaagaaccgaactacatcagcgaagttttacataaaattaagcaatgttatattgcgttaaatgaacaaaataattttgagctgttcttaatcaaagccaaccaaattaaacacaacagcagtgttgatttggcgttagctgaatttattgaacaaaaagatggtgtagaagccgcacaatcacggctttatcaacaagttagacaattcccaagtttaatgactttccatcgttttatttactatcaagtaaatgaagcggaggagggcagaggcaaagagagtttagttctattacataaaatggtcggtgatcgaattaaacagggatttcaatatcgctgtattcattgcggttatcaaagttaccgcttgtcttggcactgcccatcttgtcgaacttgggaaagcattaaaccgatgcaaagtattacagaagtgatttaacataggagaatttaaatggacaacaaaattatcgtcgcccttgactatgaaacagaagctgaagccctcaatttcgttgatcaagtcgatccgtccctttgtcgtttaaaagttggcaaagagatgtttaccacattgggtacacactttgtgaaacagttacaagaccgcaaatttgatgtctttttagatttgaaatatcacgatattcctaacaccgtcgcaagagcggtgcgttcagcggcagatttgggggtgtggatggtggatttacacgcctgcggcggtttacgaatgatggaaaccgcaaaacaaattttagagccttatggcaaagatgcaccattattgattggtgtgactgtgctaaccagtatggaagatttagatttattgcaaatcgggattaatgcgtcaccgatggaacaagttattcgtcttgcccatttgtgccaacgtgcagggttagatggtgttgtttgctctccacaagaagttgaggtattaagaactcactgtggcaaagattttaaactcgtcacgccaggtattcgtcctgaagggagtgattttggcgatcagcgtcgtgtgatgactccaaaacaagcgattgaaacaggatcagactatttggtgatcggtcgtcctattacccaagccactgatcctcttgcagtattaaaatcaattaatcaatctatcgcctaataagcggttcgtgtagaaggaaattttacaaatgactttagtgtattccacagaaattggtcgaattacaccagaaaaaccgaaggctgaacgtccgaaaggtgatggcattgtgcgtattcaacgccagacaagcggtcgtaaagggaagggcgtttgcgtaattacaggtgttgatttagatgatcgtggtttagtggcactagcttctgaacttaaacgcaaaacaggctgtggtggttcagttaaagatggtgtgattgaaatccaaggtgataatcgagatcagcttaagcaaatgttggagcagaagggatataaagttaaatgacaatgctgaattcagaaatattacgatataatcgtcagattatattgaaaagcattgattttgatgggcaagaaaagttaaaagcaagccgagccttaattgttggattgggtggattaggttgtgcagcgagccagtatttagcaagcagtggtattggatatttaaccttagttgattttgatacggtttcactttctaatttacaacgacaggtactacattctgatgcaactatcggcatgccaaaagtagaatcggctaaaaagcgtttacatgaactgaatccccatattcaaatcgaaaccattaatgcgtatttagaagaagatgaatgggctaaattgattccccaatttgatgtagttttggattgtacagacaatatgacaatccgtaatacactcaataaaatttgttttaatgtaaagaaaccgcttgtatcaggctcagctattcgttttgaagggcaagtgagtgtttttctttaccaaaaacaagatccctgttatcactgcttaagtcagttgtttggagaaaacactcttagttgcgttgaagctggggttattgctcctattgtcggtattattggcagcttgcaagcattagaaacaattaaagttttacttaatattggtcaaatattgtctggacggcttttagtaattgatggtttaaatttttctatacgagaaatgaagttgcttaaacagtcaaattgttatatatgtagtaaagaataaggttaaaattcgctcattgttcaagaattgaaaagtttggtttagacatttgacgatgtcagagattttccctactatgcaagcgttatgttcttccttagttcagtcggtagagcggcggactgttaatccgtatgtcgctggttcaagtccagcaggaggagccaaacgatttcctcctttagttttttgcttttggtcttgttttatttgtctccttttataaaacagtaattcatacctcctagaattagatcaaaagagttgccccgtacaggggctttttttatctagcaaaaatggtgaattaattttgctaataattctcttgtgggttcaatgaattttgcatctaaatattcgttaggttggtgagcctgttcaatgttcccagggcctaaaattagtgttgggcagagttgttgaataaaaggtgcttcagtgcagtaattaactgctttacattcttctcctaataatttttcaaccacctttacgatctgggcggaatgttcgcattcatagccaggaatacccgcatgtaaggctttaacttgaatgcgatccccccaagtctcaataagaggcgcaagatattgtcgcactaaatcctctgcatcttggatggctaaattaggtaatggtcgaacttctagttgtagctcacagcaagcacaaatacgatttagggcatcaccaccatgaatatttccgaagttgagggtaggataagaaacacagaataactcattatggtatttttgttttaagctatttttgagttgaagtaagttacccaccacctcatacataatttcaatagcattaattccattggcaggattactggaatggccagatttaccaataacctgaactgtttgagcaagatggcctttatgtgctcggataggtttaagagaagtaggttctccaatgatcgcacaatctgggcgaatatgtgcatgttgtgaaaaggttcttgcaccaagcatcgttgtttcttcatccgcagtagctaaaatccgtaatggctttttaagttttgctaaatcaatttgattgagaacatcaaccacgaaagcaaaaaagcccttcatatctgcagtacctaatccgtagaatttcccttctttttctgtaagctgaaaaggattgaaattccagagcccctcatcataaggcacagtatctgtgtgcccagccagtaataagccaccatctcctttgccataagttgcaagtaagttatatttttgatgagagccattaatggcgatgatttccgttttaaatcctaaatcactaaaccaataagccaataactcaatcaatgctttattggatatgtcatatttttcattcaggctacttatggtaggaatttgaattaattggcgataacgctcaataaaagagagatgtattgtcatttattgatcctttcttgagaagagtatagaaacacagcttgttagtattttaaggaaagtaagtataatcatatcaatatttaactcatctttttcaaaaaaacgaaaaattcctgttattttatctttagttttgtgttactcattgttttttttttttttttttacaatagcgtgcggggacatttatgcatcctgaaaatgtaaataaaggtttacgatgttttattaggaaaaacagtagagaaggttattatgaataaaatatttagagttatttggagtcatgctcaacaggcttgggtggttgtgtctgagttagtaaagtctcataccaaaacatccgcttacacggataaaagagctcaagtatgcacctcacattattttttagataaacagcaagataaatttaaattaagtcttttaagtctagtattactaggtatattttttagttcagtaggttcagcttcatattttgtagatggtgctacaggagtggggcgtatagaatataacggcggtactattggtattggtcgaggtagtagggttgggtttaattctattactattggtgcggactcaagagctgaacataatactgctgttgcgataggtcatgcagctcaatcaaccaataaaaatgccgtagccgttggggcaactgcaaaagcaggcccttattctgcggcttatggttatggagcaagtgcacaaggagcaggctctgttgcgataggcaacggggctacagtaaatgggaatgctagagcaattgccatcggtcagcagtcaaaagctgaaggtcagaatgttattgcgataggttatttagcaaaggcaggattagctggctctgttgtgatgggcaacaatgctacgtgggtagaaggggaaaatttacgtcagtattcaacaaagggaagagggaacgatactgttattatcggtgctaatgcgaaagcagcacatagttcgactgcattaggtagttcagctgaagcaaaagcattttctgcaacagcactaggaagattggctaaagctaaaggagagttctctattgctataggggggggagacagtgacaataatgcagctatagcaaatgggcatgcagcaattgccatggggcgtggttcaagagcgggagaggaatctattgccttaggcagagaagccaatgcggcaactactaaaacagttgtaataggtctacaggctagtgcaagtaagtcacactctgttgttatcggtgcgaatagtaagtctaccgctgagtacggtattgcggttggtggtggtgcaaatgctactggaggcaacgccgttgctcttggtagggactcgaaaggtgctgggacagattccattgcgataggtaatggtgcgaaaacaacaggggcagactctgttgttgtgggtgtcaatatcgatgtgacagatggacaattagtggcaattggacgcgaagcaaaagctggaagccattctactgccttgggttataaagcctctgccgctggtcagcactctgttgctgtgggtgaagaggcaagtacaacaacagacagatcaaccgcacttggtaataataccgttgtcagcgtgggtggcggtgtggcgttgggttatggatctaaggcagatacagctggcggtgtagaggggttaaaacaagctcattctgtcacaacggaaacaagcagcgacactaacggctttaaatccacaggaagtgttgataacaatcctattggtgcagtttctgtgggtaatgacagaatcaaacgccaaatcgtcaatgtggcggctggtacacaagataccgatgcggtaaacgtggcacagcttaaatcgctcaccatgcaaataggaggcgataacgacagtggcaaggtaggcatttggagtggtacgctcactgtaaaaggagaaaatggtattacttcctctgctaatggcagtacgattacggttaaattagataaagacctcaaagataaaattgataagattgccgctatgggtaagttaattcaaagtgcggaaaaagaatcaaatggcaatctaaaaattacctatacagatggttcgcatagcattatccagaaaggtgaaaaaggagatcgtggtgaaaaaggagatcgtggcgaaactggccctgcgggtccagcaggtccaatgggtcctaggggtgagcgaggagaagctggccctgcgggtgcagctggtccagcaggggctaggggtgaagctggtccagtgggtccagaaggaccgcgaggacctgcgggtccaaccggtgctcaaggtccagcagggcctaggggtgaacagggtctaaaaggagatacaggtccagcgggagagccaggcaagcagggtcctaggggagagaaaggtgaaattggtcctgcaggtccaaaaggagaggcaggagcaaaaggcgataagggtgacactggtgaagcaggaccaataggccctcaaggtcctgcaggtgcagctggacctaagggtgaacagggtcctaaaggtgaacaaggtattcagggacctaagggtgacaaaggtgataccggtcagaaaggtgaaacaggccctgcgggtccagtaggtccagctggaccacaaggtgtacctggtcctgcaggtccaaaaggagaggcaggaccaaaaggagaggcaggaccagtgggccctcaaggtcctgcgggtgcaactggtcctaagggggataaaggcgatccaggacaagcgggtcctaaaggagatacaggtccaaaaggcgatagaggcgaagctggtccaatggggcctgctggtccaaaaggagaaactggctctgcgggcccagcaggtgctgacggtacaagcattgttcagaaagatgcagaaggtaatgacttaacaacaaccgttaaagcagatggcgtaacggcaacggataaaggctctaaaaatactgtcaatgcagatggtatgactgttggtccgaaagacgaaaatcaaacggataaatcagctgcgacttataacagagatggtgtaacggttaaaggaaatgacggtgcagatgcaattaccttaactagcaaagaaggtcaagatggtaaaacaactaacaccttggcacttaaaggccaaaatggcaaagatgcagtaagcattacttcgggggcagatggcacagcaccagaaattagctttgctaaaaatggtgagggtacggatgctaaaggcacgggctctatcactggcttaaaagatgttgaacgtaatccggacggcacggcgaaagacagaacggctgcagcgaatacgggctatgtcgatgatcgcttaaaagaaatgaacgatcgaaaaccgtttgagtactttgagaaagattctgtaacaggcgaagtaaaaactgaaactgtaaatggtaaacaagtaccagttacgcttgttcgcggaaaagatggtaaattctataaagagagtgacttaaaagggaaagttttcgatcctgcaacaaatacatataaaaatgcagatggtacacctgcaacattaactgaggttgcttcaaataatgttactgttcaagcaatgccatcggatgcaagcaatacaccaattgcgatgagcaatgtgggaagtggtttaggtttgaaagatgatgctgaatcaaataaaacggcacttacccctacagatgcacaaaaagctattgctggtgataacaaagacggtaaaggcggcttattggctcaaacgggtaatgcgttaaataatgtagcgacagtgaaagatttacaagccattgcacaagcgggcttagacttgacgggtaacaacgccgataccactgtacatcgtccattgggtacgaagttaaccgttgagggtgaaggcaaatggaatggtaaggactcagcggctaataacctttatgtggaagcgcaagaggcagataacaaacttgttgtgaaaatgaacaaggatttaacgaacttaaattctgtgactttaggcactgcgacaatgactggtgataagaatacaatcaaccttactggtgcaggagagaaagtcgaggaagagtttgttaaatgggaccctgtgactaaacaacctattcgtgatgagaatggcaatctccagaaatataaagagaaagttgatcctcgtgtgaaactgagtggtattgctgatggtgatatttcaccgaatagtactgatgcagtgaatggtcgtcaagtttatgttttaaccaatcgtatcaggttcttccacaccaatgatggtcataatgcagaggagcaaattaaccataagtcgaatacagtggagtctcgtgcaacaggttcatactctactgcagttggctacaaagctcacgcgaaaggggagagttctgttgctttaggtaacggggctacagctggagagcaaggcgtggctattggtcacggtgctgtggcgtcaggtaaacaatctatttcgattggtaccggcaatgtggtgagtggtaataactcaggtgctattggtgaccctaatacaattaaagcagatcgctcttatgcattaggtaataataaccaagtgaatgcaggtcaatctgatgtgtttgttgtcggtaacaacgtgaaaaacacaaccagcaactcggtattcttgggaacaaactcaggctatgtggcagcaggtgcaaccactgcgggggcaggtgctttagaaagccaagtaataggtggtgtgtataacgcttatgccggcggtaaagcaactgaagttgtaggcgtggtgagcgtgggtaatgtagacagtaatggcaaaatggaaactcgtcgtattcaaaacgttgcacctggtttaatctctgagcaaagtaccgatgcgattaatggtagccagttgtatagcttaatatctcagcacaaggtgcatatgggcgatattcacaataagatcaaccgtaataataaagctctgcgtgcgggcattgcaggttctaacgccgcagcaggtttaccacaggtttatctccctggtaaatcaatggttgcagcatcagcggggactttcaaaggtcaatctgcattggctgtgggttactcaagagcatcagataacggcaagctgatccttaaattacaaggtaatgcaaatactagtggtgaaatgggcggctctgtgggggtaggttatcagtggtagatatgataggagcttataacaaattttgttataagctcctattttgatatcacgattacttcacttcacgaatcataatttctgatgggattacactaccttgccaatataactcagtcgaaacttttaaggctaaatcgaggtaggcttggctgatttcgtggttaggatctgctaccaccgttggcgtacctttatctaaatcttcacgtaaacgaatatgtaatggcatttgtcctaacacttgcgtttggtatttttctgccactttatttgcaccacctgtgccgaaaatggtttcgtggtgtccgcaatttgcacaaatatgtacgctcatattttcaataatacctaacactggcaccgatactctttggaacattgcgatccctttgatcgcatcaagcaacgcaatatcttgtggcgtagtcaccaccactgcccctgttactggaatttgttgtgaaagggtaagttggatatcgcctgtacctgggggcatatcaatgaccaaatagtctaaatcaggccaccacgtttcttggagtaactgacttaatgcactgcttgccattggtccacgccaaatagttgcgttatcaggatccattaaatagccgatagaattagagtataaaccgtgggcttcaatcggggtaatatgtttattgtctggcgatacagggcgttggtttgctgcgcctaacatatgtggaattgaagggccataaatatccgcatctaaaatacccacccttgcaccttgtgctttaagagctaacgcaagattgaccgatgtggtagatttacctacgccacctttacccgatgtgaccgcaataatgtttttcacaccatttaccgcagggtgactattggcacgctttaaggtcgcaatttggtaatttaacacccatttcacaccgcttgcaccactgatttctttcagttttgcttccgttgttgcctttaattgttcaaatccgctgttccacgcaaatggtagcgtaaattcaagacgtaaaatcccaccgcctaattcggctttttttaacgcattcaatgcgattaaatctttttgcaaggttgaatgttggaaaccttgtaaaacgcttttaacgccagctaattgctgttcggtaagttggttcatttacttatccttatgatattgtcgagttaaatctttgctataaatagtttcacttgcattttgttcatcaaagccttgaattgttggagcaatgctcattcggcgttgatattgaaaaagcggtaagattgcgacatcttcttccaattgatgagctatcgtagcaattattctttgccttttagctgtatctaaaggctgttcttgtaattgtaacaacagttcatctactttagcgttgctataactacttttattatcagggctttggctatgaaattgcgttaaaaagagtacaggatcaggataatccgcacaccagcctgaacgaattagttggaaatctttttgctctcgttttgcaagtaactcttcccaactaaccgcttgtaattgtactctaaatagttcagattgccctaatgctcttactattcttgcagcaatttgtgaatgttgcccttgtctatcataactcaaggttaattttagcggattgcctgaatggatcccttgttcatttaataactgctctacattggtatgagaaagcgaatgtctcatttcactaaatagctgtttcggtatcattaaatgtgaaggtatgccatttcctttgctgatttctatcggggaaatcattgctcgcactgcttgacgtattggcttctgagcaaataacggatcattgaagttaaattcataaaagtaattacacaagcgagcaaaacgtttttcgtgttgatgatagttttccaacggattttcaataatatcgaaacggcttggattttgtactgaggtaattaaatgatattgcactacttggaaaggcgtatttttatcccttgctttcagttgcaacagatttttttcaaaatgctcaacgcgataactaccgttactaacgagatccgttgaatttggtttctgacctagataggttggcaacaatgcggaatgagccagcattttaggcagttgataattcgctttttccagctgaacttgtaaagtgtaagggtttaacgccttaactcccaaagcatcagggggtaattcaccagccaagacagctcggctattaacaatccccatatagactaaataatgtgctagtggtgaggcatttttagggtcactcaaccgttgccagcttgcaacaaaatctgcggaagtcaccgcctgatcattcgaccatttcgcattttcatctaaaataaacagccagtttttaccatcttcactaaaccactcttttgccacagcattctgaatttgccctttaggatcaaacgccatcaagcctaaaaatagatctcgaacaaccccagcctcagcagatattctgacaaaatgagggtctaattgtagctcggttgcgtaaattgcacggcttaaaacattggttagttctgtattaggcaaaggtctaacggaaccgttattctcttctggatcgcaggcaacaaaccccacgatacaagcggtcacaaaaagcccttttttgataaattgcacaatgcgttgaatagatgccattttaatgaattgccgttaatccaggaaatagattgcttaatccagcaacaataatttcaatacctaatgccattagaattaagcccataatacgagtaacaacattcgagccagttttaccaaggcgtttcaccaaaggggctgagaagcggaataaaatataacagatacctgcaaataagatgattgccacgctaaatccaaccagatctacccaagtatgataacgtgttccccaaacgatggtcgaacctatcgctccaggtccagccataatcggcattgctaaaggcacaaccccgatattttcatattcagacaggtcagcatttttttcttccttattctgcttatgttcgcccaatttaccgctaatcatcgtcatcgcaatactcacaatcaaaatccccccagcgacacggaaagaattcagggaaatactgaaagcatctaaaatcactttcccaaaaaataggctgacaagcaaaataaccccaacagaaacggaggtgatcaaattagtacgattgcgatcagcttcatactgatgagcagtcatactaaaaaagatcggtaaagttccgaatgggtttacgatagcgaataaaccgataaaaaactgaaggtaaatcgcaaaattaataatgatatccacgggcttctaaataaggactaaaaaattcggactattataatcaggaatgttggaaaaggcttgtaaaaatttaattttcttatcgaggataatcaatagacgaagttgtagaaatttgatgtgaatctatttcagtagttccataaggcatttaggaaagctatctatcataatattccatttttgaataaaaaatttcatttttgaattgacatagcaatctagacgtctaaaatagcctagattttaatttttgataaagtgtggattgataactatgattcagctgaaaaatatcagcaagcagtttgaggtgaaagggaagaaaattactgcccttgataatgttagccttgaagtgccaaaaggtacaatttatggtgttatcggtgcttcgggggcgggtaaaagtacgctcattcgttgcgtaaatttattagaacgtccaactatcgggcaagtgattgttgatggtaaagatttaacgacgctttctgagaaagagttaaaccttgctcgtcgtaagatcagtatgatcttccaacattttaatttgctctcttctcgtactgtgtttgagaatgtggcgttatcgttagagttaaaccatacgccgaaagagcaaattcagcaaaaagtcagtgagttgctagagttagttggtttggcggataaacacgatgcttatccgagcaatctttcaggtggtcaaaaacagcgtgtagcaattgctcgtgcattggcaaatgatccgcaggtattgctgtgtgatgaagcaaccagtgcgttagatcctgcaacaacgcagtcgatcttacaattgctgaaagatattaataaacgcttaggcttgacgatcttgttgattacgcacgagatggaagtggttaaacgtatttgtgatcgtgtagcagtgattgagaaagggcatttggtggaaagcggttcggttagtgagattttttccaatccaaaaacagaattggcacaacgttttattcaatctactttccatattgaattaccgcaggaatacatggaacagctttctcaaacacaaacgccaactagtaagccgatcattaaatttgaatttacagggcgttctgttgatgcaccattgctttctcacgcatcgaagaaatttgggatcgactttagtattttgatgtcgcagattgattatgcgggtggtgtgaagtttggttttgtgattgctgaagtagaaggtaatcacgatgcgattgcagaagcaagattttatttgattgataataatgtcaaagttgaggtattaggttatgtggaatgattttatcaatgaactcacaccaaaaatgtgggaattggtggcgttgtccacattagaaacgctctatatggggtttgctgcaacagctttggcggttgttgttggtatgccgattggcttcattgcttttttaacaggcaagggagaaattttagagcataaaggtttacatcaagtgcttgatgtgattatcaatattgggcgttcagttccctttattattctacttgtggtgttattgccttttacgcgtttactggttggtacaacactaggaacgacggcggcgattgtgccattaagtgtttctgctattccgttttttgcacgtttaacctcaaatgcactcttagaaattccaagtggtttgacggaagcggcaaaatcaatgggggcaacaaattggcaagtggtttctaaattctatttgcctgaatctttgccgattttaatcaatggcattacgctgacgttggtcgctttaattggctattcagcaatggcgggggctgttggtggcggtggcttggggaacttagctatcagttacggcgaacatcgtaatatggtctatgtaaaatggatcgcaactgttattatcgtggcgattgtgatgattagccaaaaaattggtgataatctcgcaaaacgttacgatcatcgttaatttgcaaacatacttttaagaggactttcctatgaacttcaaaaaattattaggtttagccgtggtttctgctttagcattaactggctgtaaagaagagaaaaaagcagaagctccagcggcagcacctgctccagcagcacaagcacaaaaaatcaaagtgggtgtaatgtctggtcctgagcatactgttgctgaaaaagcagctcaaattgcaaaagaaaaatatggtttagaagttgaatttgtgttgttcaatgactacgcattaccaaatacagcggtaagcaaaggtgatttagatgcaaatgctttccaacataagccttatttggataaagactcttcatcaaaaggtttggataacttagtgatcgtgggtaatacttttgtatatccattagctggttactctaaaaaaatcaaaaatgtcgctgagttacaagatggtgcagtggttgctgtaccaaatgacccaagtaaccttgctcgtgcattaattttattagaaaaacaagacttaattaagttaaaagataacaccaacttattctctacttcattagacatcgttgaaaatccaaaaaacttaaaaattcaggaagttgatacttctgttgcggcgaaagcattagatgatgtagatttagcggttgtaaataacacttatgcaggtcaagttggtttaaatgcaacagaacacggtgttttcgttgaaaataaagaatcaccttatgtaaacttaatcgttgctcgtaaagataaccaagcaagtgaagcagtacaaaacttcgtgaaagcataccaaactgaagaagtgttccaagaagctcaaaaacatttcaaagatggcgtggtaaaaggctggtaatttaactcaacaaaagagagtgatttagtactaggtactagtcactcttttttattattgagaggatataatatgaatttcaaacacttgttaggattaacctttgtttctaccttggttttaacagggtgtaatgagaaaaaagaagtattaaaagttggtgtaatttcaggacctgagcatgaagtcatggaagtggcagctaaagttgccaaagagaagtataaccgtgatttagagttagtgattttcaccgattacgcaacaccaaacgaagccttaaataaaggcgatttagatgtcaatgcgttccaacacaagccgtatttagacaaacaaatcgcagataaaggctacaaattaataccagtaggtaatacattcgtttatccgattgcagcctattctaaaaaaattaagtcaattaatgaacttaaagaaggcgataaaattgcggtaccaaacgatccaacaaatttaggtcgagcactaattctacttgagaaacaagggttaattaagttaaaagacaatactaacttactttcaactcgtgtcgatattgtggaaaacccgaaaaatttagagattcaagaagttgaagcgccattgcttcctcgtacccttgatgatgtagcattttctatcattaatacaacttatgcgggtcaagttggtttgacgccaaccaaagatggcatctttgtagaagataaaaattcaccttatgtgaatttaatagtttctcgtgaagataacaaagataaggaaattgtcaaagattttattaaagcctatcaatctgaagaagtgttcaataaagcgaacgaagtgttcaaaggtgcgatggtaaaaggctggtaatatttgctataaaaatatagatattatttagcagcgaattgttgtgaaatgtgtttggcatatagacaaaagagttggttttaattatttttctaattattaccaactctttttattcatttttaaaaaagagcttaaagccttgtattataaaagattttaagccctatctatgactattttttcttcgcatatttgagcgagtcaattgccactgcaaagatgatgatactacctttgatgatgtactgccagtatgggtttacaccaatataggttaagccgtagttgataacggtgaagattagtactcctgttaccacgccgattactgtacctacacctccagcgaaagatacaccacctactacgcaagcggcaatcgcatctaactcgtacataaagcctaagttgttagttgcactaccgatacggccagcttctaacataccaccgaatgcatagaaaatacctgcgatcatatagataaccactaagttacgagcaacgtttacaccagatacttttgcagcttctgggttaccaccgatagcgaagatatttttaccaaagcgagttttgttccacataatccaaacaaggattgaggcaatcgccgcatagatggtaatgtaagacaatctaaagctaccgatttggaagaagccttgtgcaaaggttgagaaactttcgtcaaagcctgcgattggtgatgaacctacagcatcatagtagagtgagttgataccatagacgatgatcattgttcccattgtcgcgataaacggcgttacgttgagataggcgataactaaaccattgactaagccgatgacagcaccgatagcacatacagttaaaataaccactggaattggaatttcgcctagatttgggaacactcggttcatattatccattgcttgtagcattgttgcagcaaccacagcggctaaaccaacttggcgacctgcggataagtcagtaccttgtgatacaagcaaaccagcaaccccaagtgcaatgattaaacgcactgaagattgggttaagatgttactaaagttgcgtaaacttaagaaacttggatcttgtgcgataatgatcactaataacacaagcaatacaaaataaatcgcattttgtttaagaaaatctaaagatttagtttgagtaagtgtggacataattcacttccttcttttataaatatttcgcagaaagctgtaaaatctcttcttgagatgttttagctgtttctacgatccctgcaactctaccattgctcatcactaaaattcggtctgtcacccctaataattcaggcatttctgatgagatcataataatgcctttatctttttgagccagttgcataatgagctgataaatctcatattttgcgccgatgtcgataccacgagtaggttcatcaagcataagaatttcaggttgcgttaatagccaacgtccgataactactttttgttggttaccgcctgacaacgatccgatatttgttttatgagatggtgttttcacattcatggaatcgatcacccattgggtatcgctcttcattttagcactgctgagtaatccaaacgaacctaagtaggatttcatattagaaatcaatgagttaaattcaatgcttaagttcgcatagatccctgttgaacggcgttcttccgtcaccagtgcaaagccgttgttgatggcttctaaagcggtgtgatttgccatttcttttccgtgcaatttcactgagccttcttttcgctcacgcacgccgaaaatggtttcgacaatatccgtacgttttgccccaactaagcctgcaatccctaagatttcccctttgcgtaattcaaagctgacatcttggatagacggttgatttttggcagtcaggtgttgtacttctaaaatcacttcttttggtgtattggtttttggtgggaagcgttgagttaattcacgtcctaccatcattgatacaatgccgtccattgtcgtttcttttactgggacagtattgatccatttaccatcacgcaagatcgtaatttcatcacaaattttgaaaatttcgtccattttgtgagaaatatagataatgccacagccacgattttttagtttttcaataattttgaacagatgttccacttctttttctgaaagtgaagacgttggttcgtccataatcacaattttagcgttataagagaacgccttggcaatttcgatcatctgcatttgtgatacagagagatttgccactttttcttttggatcaatatcaatatcaagttcatcaaaaatcgctttggtgtctcgatacatttttgcgtgatccacaaacatacctttcaatgggtagcgaccaagccaaagattgtccattacgttacgctgacggacaaggtttaattcttggtgaaccattgaaattccattctctaaggcttctttagaggttttaaaattaacaggtttgcctagaaatagaatatcgccttcatctttggcatagataccaaataaacatttaagtaacgttgatttacccgccccattttcacccattaaagcgtgaaccgaatgagaacgaacagtcaagtttgcgttatctaatgcttttacaccaggaaaggatttactgacattggtcatttggagaagcacttggctctcttgatgttgtgtattttctgtcatatccaacctcacaaaatagggggaagatcccttcccccattactacaaatcattattttaagaattcagaaaggttatttttatctacgccaacataaggaatacgtaatactttctcttttaattcccatttagtaccttcagttggtgctttctctgcggctaagtttttagcgagatgcacaactgctttaccttggtttacaccgtcatttaatacagtacctgcaatttcacctttttggattaattgaagtacttctggtaacgcatcaacaccgaagataggtaattttttaccgtgtgctttagctgcttctaatgcacccatcgccataccgtcgttgtttgcaatcacaacttcaatgttgcttgcttttgagctagataaccaagcatctactttatcttttgcaagagctgcgtcccacatacctgtatccacgaagagttcttctgtttggatacctaatttgttgatttgctcaacagaatatttagtacgagcttcagcatctgggtgacctggttcaccttttaacataacgtattggattttaccgtctttgtttaagtcatacgctgggtttgctttccagtgttttgcgattaattcaccttgaattacgcctgactcttgtgggttagtaccaacgtagaatgctttgtcgtagctagcaattgccttatcgcctgggtctttgttaaagaataccacagggataccttctggttttgctttaccgataatggttggagctgctgatgggtcaactaagttgatcgcaagagctttaacgccttttgaaattaatacatcaacttggtcgttttggattgattgagcgttttgagagtcgttcattaataaatcaacaccacccactactttcacttctttttcaatttcttgacgcattaacgacataaagttgtcatcatatttatagattgtcacaccaatgcgatccgctgcttgtgctgatgtagctactgcacctaaacctactgctaatgcgattgtactaagtaccgcttttttcataattagctcctttatggatttctgaatgagataaaattgtcactatagatagtaactattggaattttactccaaaaaaagcaaaaaaaatgtgatcgcattcacaaaatcgcaagcggtttcgttaggtttttccgattgatgaaattgttttcagtttatttttaagttctataacccattgtttttgttttgatttcttattttcatcagagttagtaaagatatctgataaaaaatcaaacgagttgtgattgatatataaacgctttaagctgacataacaagcagtaagggttcgttgagcataaataaatccttgtaggtttctttcatcgttatgatccaaaataagcgaatttaaggaagtagaaatagcaatatgctgaaaacgatcggcaaaaggcaacagcggaaaatctcgtttaaactgttgctttgcttgttgagcaaatattttcccttgtacagagagcggataaatcatcattgcactgtggtaaccactgcttgcttcaggggttggcgtaatctgaactaaattaaagccacaagattgccaaaaatacaataattcaggagtaagcccaaaactgaccgaaacaaaatctacaagcggtggcatttgcgaaataatctgcgaaaccaaccgcttgccatagccttgcttttgatattcaggctgtaccgcaatacgggaaattcgcacagatttcaaacgacaagcgtcaggtaaattgccttggaaacagagatattgagcaaccaaactcccttgcggacgacgttcaccacgccaaatagcctgagtgagttcctcatctaatcccccttcattcaccgcccagcaacctgcaatcagcctttcttgctcttcaagataaaaatagtgttgatcaggtgcatcaaacagacgacgtaaatccgttggcgttgttttgtaatgtgcttgggcgagtagatgatagaaattagtatattgctctacgcttcgctccccctgcttgcggggggagctgccgaaggctgagggggggattttatcttccagcagcaacaattgattaataaaagcttccaacggatcattctcccccatctcaacggttggcttaatgtccactgtttcgtagaacggcttaatgtcggcaaaaacttcaaacaaaaaccacgtccagtaccttcataattttgagttgtggtggttagcaccactttatcaaaataggcacaaaactgttgcaacatcggcaaaggcaaactcgctgcttcatcaacaaacaaccattgatttggtgagatatttttctgctcgatcatctgaattaaacgatcaggggcaaagaatttaaccttatcactttcaatccccttccaaaaatttggcaaggctgaatggctacgagcggtaatagataccgcatattgctgagagagcttttctgcgagcttgcccgataatgtcgatttgccacgaccacgaggggcgagaataagatgaatatcggcaggatcaagcggtaagttatcgaagatattttgctgatcttgggtaaaaacaatttccccccttccccctgcttcgcagggtacttcccccgtaaacgggggcagaatttcattgaccagcgttttaaaataacgaaagaaattcggcgtggcaatcggctgttgagcgttccaacgtaacgcatcaaaatcgacttgttgctctaaattatcccattctggacagaccaaatagagcgtgccaccttcttgaatagtgcctgccacaatcgccaatgcgtcaagattaagacaaactccgctgctggctcgcatatcataaactgcataaggaaattcttgaccgagtaaggttttagcattagaaaaggggagagatatcggcgaatcaggtaagaaaataccgccgacatcggcagtctcaaaagaagatgggagatgatcgataaccgttagatgacgcattattcttcaatcgttttttccgcaatatagggatcatcaaaccctagcgactgcataatttccgtttccagactttccatttcttcggcttcttcatcggttaaatggtcgtagccaagcaaatgtaatgtgccgtgaatggctagatgcgcccagtgagcttcgagcggtttttcttgttcaaccgcttctttttcgacgacctgacgacagataatcaaatcccctaacagcggtaactcaatcccttccggcacttcaaacggaaaagagagtacgttagtcggtttgtctttgccacggtaggttaaatttaactcgtggctttcggcttcatctacaatacgaatagtgatttccgtttcaggataatccgccgttttcgcttccatggctaacgctttatccacccagtgttgaaattgagctgccgtcggtaagcctgctgtattttcagaggcaatttggagatcgatatataaattcatttgcaaaaaattccttaaatctgaccgcttgttaccacttatccgccgcttcctgatcgctctcacgcccttcaatccaacggtcgcagtggtcggtggtttcacgtttccagaatggggctttggttttcagatagtccataataaattcattggcgtgataggcgttgccacgatgagcggaactgacgccgactaagacgatttcatcgcccgtataaagctgtccgatacggtgaataaccgcaacgcgttgcagttcccaacggcttcttgcttcatcaacaattgctcgcaaggctttttcggtcattgcagggtagtgttccaagtataaacctgacacgctatcgcccaaattcatttcacgcactttgccgacaaaaagggtagttgcaccaacggaatgttgttcactcaaccatttatagatcgcattttgatcgaagggatcttgttgaacttgaataagtgtttgttccatttagcccccagttactggtggaaagaaagccacttcatcgccgtttttaatttcagcagacaaaggggaaatagtttgattaatggcgactaacaatttccctgcttgtaatgctaatgcccatttgtcgctacgttcggctaaatgttggcgaagctgttcagctgtggcaaaggttgcttcaacctctaagctatctacgcccactaattcacgggtttgggcgaaaaagagtactttaatcattgtgtatttatctcgtagtagggtgggtcttgacccaccattttcttatcccattttgatgttgtcggtgggttaaaacccaccctacgatttagcgacaaaatcgcctgatttcccaccgcttttactgagcaagcgaacttgttcgattaccatatctttttgtaccgccttgcacatatcataaatcgtcaaagcagcggcactggctgcggttaaggcttccatttctacgccggttttgcccgacagtttgcaccgggattcaatccgtacttgatttttttcaggtaatgcttcaagttgcacttccactttagaaagcagaagtgggtggcaaaggggaatgagttcccacgttctttttgccgcttgaatgccggcaatgcgagcagtggcaaaaacatcgcctttgtggtggttgcctgaaatgatcatctgtaacgtttcagggttcattgtcacaaaggcttccgcacgagcttctcgcacggtatcttgtttggcggaaacatcaaccatattagcttcgccgttttggtttatatgggtaaaggtgttcattattttctctttgtaaaatatcaatgatgtagggacacactgcgtgtgtccgcattaattaaatatacctttgaaaaatcagaaaatggacgccaagcgtccctacaatgtttcataatagatttttggacacacgcagtgtgtccctacagattaccccccaatcgacgccaaattatttctcacgccactatcgccaatatgcaaataatggtgttcacgcttgccttgcagagcggattttaatctggcttcgagttgaaattgttgctcgtccgattgcaataaatcccgaatatcaatcccttcttcgccgaacaaacaaaggtgcaatttgcctaatgccgacactctcaaacggttacagctggcacaaaaattcttttcataaggcataatcaaaccgatttccccttgataatcagggtgggcgagaactttagccggtccatcagacatcgctttgggttgtaattgccaaccattttgggttaatcgttctaaaatggattgccctgaaaggtgctgttgctggaaaaagtgatccatttcgccggtttccattaactcaataaaccgcatttgaatagggcgatctttaatccaacgcaagaaatcgtccaagcctttagcggtatattgcttcatcaatacagcattcactttgacttttttatagccaatctcaaaggctcgctcaataccgtttaacaccgttgcgagcttattttcccccgtaatcaaatgaaattgacgtgggtcaaggctatcaacactcacgtttagatgagtaattccagcttgttgccataactcaacatcacgttccattcgataaccgttggtagttaatgcaatttggcgaatacctgccgtttgtgaaaggcggtgggcgatttctagaaaatccttgcgtaaagtcggctcaccaccagtaatacggattttttccgtgcctaaattggcaaaggcttgagcaacacgttgaatttcatcgacagacagaaaggtttgtttatgcaacggcggacgatacccctcgggcaaacaatagttgcaacgaaagttacagacatcggtaatcgacaaccgtaaataagtgtattgacgttggaaacggtcaatcaaagcttgctcgaactcgttccctacatttctaattgggatttgcaatgtgacacctttctaaatatgagaggagagccgatttctcaactttccctgtgtaatcaacaaattacaggcacagtttccatatcgctagacttaggaaaacaggctcggggtcggataatttcgggaattgtagtaactgaatgacaattaagcaaggggttgttatgtaattgtttaatttaacaacgtataaaagtgtttttaacgtagtactattaaaaactaagtgcgaaagtgcttagccttttgtttttgcttaaaaaggaatgtgatatattgcacggaaattttaaggagatacgatgaaaaacaaatttcttcttttttcagccctaagtggttttttctgtatcgcttttggggcttttgcggctcacggtttggagaaagtcttggatcagaaagcgttggcgtggattgaaacaggcttgcaatatcagatgtttcatacgttagcattgatggcgttgggtttatttcaaattgcaaatttttcgcaaaatccgcccgcttgtagagccaaagcctttaacattattggcggtagttgggcgttagggattttgctgtttagtggcagtttatatgcgttagccttaggggcaagccgaatttttgtttggacaacgcctattggcggtacactatttttagtgggctgggcagcgttggtttatattagtgtgagaagtcataatgaataaattagccttatactgccgcacaggttttgaaaaggaagtggcgggtgaaatcaatgataaagcggctcaattgggaatttatgggtttgctaatctcaaagagaacagtggttatgtaatttttgagtgctatcaagcaggggaagcggatagattagccagagaattagcctttaatcagttgatttttgttcgtcaaatgattgtagtaggcgagttgttgcaggatttacccgaaggggatcggatttcgccgattgtggcacaatatcaagccttaaatccgaaaaacagcaatgagatttttgttgaaacgcctgatacgaatgaagccaaagaacttttgactttttgtcgtaaatttaccgtgccgttgcggagtgccttgaaaaaacagggctggttaggggcaaaagaaacggtgaagcaaagtattagcttgcatattctatttgtgggatcgggcaggtgttatgtcggatatgcctataaccataaccgatcacccttttttatggggatacctcgtttgaaatttccagcagatgcgccaagccgttcgacattgaaattggaagaagctattttgacctttgtaccacaagcagaggagaaaaaacgttttaccgagcagatgtacggtgtcgatttaggggcttgcccaggaggctggacttatcagttagtcaagcgtggtttgtttgtctatgcggtcgatcacggcaagatggcggcaagtctgcacgacacggggcgtattgagcattgtgcggaagacggttttaaattccaaccgccaaaaggtaagcagatcgattggttggtgtgcgatatggttgaacagccgttgcgaattagtaagttaattgcaaaatggttgattaacggttggtgtcgggaaacaatttttaacctgaaattgccaatgaaaaaacgttatcaagaagtgcaactgtgtttagatacgattgcttcgttattagagaaacaagggctgaaatttgctattcaggcaaaacatttgtatcacgatagggaagagattaccatacatattaaattagtataggtctggagaagaaaatgaaattgattaaaaccgcctttgtttcaggtttagcactcttatccgctaccgtttttgcaactcaatgggaaaaaatccgtacgcctattgaaggcaaagctcaatccattggggggtatagcaacggctgtattattggcgctcaaccgcttgcattaaaaggcgaaggctaccaagttattcgttctgtcaaaaatcgttactacggacaccctcaattattaagctacttaaaaaccttagcaaaaaatgctaaagcatcaggcattccaccgattttaattggggatatgggaatgcctgcaggtgggcgtttttcttctggacacgccagccatcaaacagggttagatgccgatatttggcttcgttttggcccaatggacgatgaaacagctcgcaatccagcaggtttggcgaccattatggttgatcgtaagactaacgtagtagatgaacgtctatggacggcaaaccatacaaaactactcaaactcgctgcgtcagatccaagagttgatcgtatttttgtcaatccagcgattaaagtgaaactctgtaataccgcaggaacggatcgcaactggctacgcaaaattcgtccgtggtacgcccacgactcgcattttcacgttcgtttaacttgccctgctgatgcggtgaactgtgaaaatcaagcccctgtgcctgctggtgatggctgtggcgaagaactttattcttggtttgagcctgcaccaccatcagcaacgccaaaagcaaaaaccattccacaaccgccacaactttgccaaatgatcttatcatcacaaggtttataagcgacttatgcgtttattcattgcagaaaagccaagtttagggcgtgcgattgctgatgtattgccgaaaccccatacccgtggggacggctttattcagtgtggcgaagacaatgtggtcacttggtgtatcggtcacttgttagaacaagccgaacccgatgcttatgatgaacgtttcaaaatgtggcgaatggagcatttgccgattattcctgagcagtggaaactgatccccaaaaaagagacgctcaagcagtttaaagtggtagagcgtttaattaaacaagcggatattttagtcaatgcaggcgaccctgatcgtgaagggcaactgttggtggacgaagtttttggctacttaaatttatctcctgagtgtaaatcccaaattcaacggtgtttgattagtgatctcaaccctaatgccgtcaaaaaagcgattgaaaaattgcaatttaaccgagatttcgtaccgcttgctacatcggctttagcgcgtgcaagggcagactggctatatgggatcaatatgaccagagcctatacgctacaagggcgttgggcaggttataaaggcgtgctttccgttgggcgtgtacaaacgcccgtgttgggcttgattgttcgacgggatcttgagatcgaaaattttatcccaaaagattattttgaagtgttggcaaatgtggttgtccctgaaacccaagagcgttttcaagcacaatggcaacccagtaaagcctgcgaagattatcaagatgaagatggacgagtgctttctcgcccacttgctgagaatgtggtaaaacgtatcacggatcaagccgcttgcgttaccgaatatcaagataaaatggaaagtgaagcagcaccactcccttattcactctcagccttgcaaattgatgcggctcgccgttttggcttatctgcccaagatgtgcttgatgtttgccaacggctgtatgaaacccataaattgattacttaccctcgttccgacaaccgttatttgccgaatgaacattttgccgatcgcctaaaagtgatggcggcaattgctcatcatttgcctgagtatgcacaaaagcccgatgcggttgatccgaataagaaaaaccgttgctggaatgacagtaaggtagaagctcaccacgctattatcccaacggcacgtcaagggcaagttcacttaactcagaatgaacagcggatttatcagcttattgctcgacaatatttaatgcaattttgccctgatgcagaatatcgtaaaggaaaaattgtgttaaatatcgcagggggaacttttgttgcgcaagccagaaaccttgttgttgcaggttggaagtccttgttaggcaaagaagataatgatgaaatcgttgaacctttgctacctgtggttaaaaaagatcagcagttatggtgtgaaagcggtgagatcgtcagcaaaaaaacacagcccccacgccattttactgatgcgaccttgttatccgcaatgacgggcattgctcgctttgtacaggataaacagctcaaaaaagtgttgagggaaaccgacggcttgggtacagaagccacccgagctggtattattgaattattattcaaacgtggctttttaatcaaaaaaggcagaaacattcatagtacagaagcaggacgaaccttaattagtgccttgccagatgttgcaacacagcctgatatgacagctcactgggaaatgcaactaacagacatcagcaaaaaacaagccagttatcaacaatttatggcagatttaaaccaacgattgccgagtttattacgttctccaaatcagcagattttgcaaaatttggcgaaaataacaccgcttacaatgggttctaaatcacgttatgcccgtaaatctacgcaaaatgttgaaaaataaaccgaatacacagaaattgataaaatccacttgcaaggaaaagtaaagatagttattattcacgccatcgaaagttaattccgcaacctgcggaattttattttgaacagattaaagagaacacaatgttaattaatgtactgactattgtttatctcgttgttgcaatcttcctcgttggctttattttaatgcaacagggtaaaggtgcagacgctggtgcttcatttggtgctggtgcagctggaacggtatttggttcagcaggttctgcaaactttttatcaagaacaacagcgattttagcgattatcttttttagcgtaagcctcgttatcggcaacttaaattcacaaactgcagcaccaaaaagccaatttgaagatttaagtaacgtagagcaaaaacaagaagttactccagctaaaatagaaaatagcgatattcctcaataaaaatagaatttacgctctggtggtggaattggtagacacgctatcttgagggggtagtgtccagaggatgtgcgagttcgagtctcgcccagagcaccaataatccaaatcatagattgtaacataatctcaaaagaccagaatttacaagattctggtcttttgctatatcatctatacccaaacggattacataaggttcaatcttgaattagtagaaagcacacagcacactttttcaaaaaacgcctttttctttttcgttgaactctatagaagcatcgcaactgctacattttgagtagatttttcttccagtttgtgactgaatcaccttttccatctggactcccctgtgtttactgatattgtatgaatacactctattttaggcagcttcgtttggttgtagattaagtagcacctcttagtatgctttgccaaattggatttcaaagaaaattgcccatcagcttttggtcaaggactaaaagaggaggtattagatattagtgatgaactggtactgaatttggtaaatcaagtatctagtctattgggaggcaaaaataatcgtgtctatcatggttcttttatagaaaaaagcaacatgattaaaaattttccttttgaattcgataaaacttactcattagacaaatcttctacgggaccaacacccatcagaaatgaagcatttattttttcaccaaaagtataatgcgacgtttaaaagcatccgtgaaaattgattgaggtcttctggtgtttttaggtttttggcaaattccgctgccaaggcgtgaagttgtttttcgttcataataaaatacctgtgtctgaatgtatcatctcagaaacaggtatttacacaaattgtgggagaggctctttaaatcaagtaaattgtgatttacctctcattttttaggtttataccttgtcatttggtcgagaaagttttactctatggagtatattttcttttgtgttattttttatggagtaatcgtttcatttaatgtgcgatgaaacattaggaggctatatgttattaggtgatctttctcgtgatgattatattctttcacttccgcctgtctttgccagactatgtgccaaacttaaaacccttgatttagttaatctgccactaggttggcaagatttagaagagggtgtaagaatgaatgtgatggaatttgaaacctcttccccagaaggaaaaaaagcggagctccatcgtaaatttattgatattcaattgttgatatcaggtgaagaagcgattgaatatagtttagcctatcctaacttagcactttatgatgaatatcgtgatgaggacgattatcagcttacaccaaccttagaacataaaaatgttgtaattttaaaacctaatatgtttgctattttcttaccttatgagccacacacaccaggcaattttgtgaccgaaagtaagccattgaaaaaattagtggtgaaagtgccagtggagatgataggaggctagaatgtcagcccgaggtaaaattctagatacgattggtgcgttacaaaatagtttaactaaaacagagaaaaaaattgcgacggtgattttatctcagcccgatctattgaaccaatgttctttatctaaagtggcaaatcaattagatgtcggcgaagcaacctttattcgtttttgtcgaacattgggatttaaaggttatacagactttaaactcgatcttgccattgaattggctactcagcaaaaagagagtagtacgttgttagatacggacgttgcggaaactgatacacctaaagaaattgcaattaagttgcagaatacgctgaataatgtgattgcagaaaccgtcaatctactcgattatgcagagctagaaaaagtggtggaagaattgcgtaaagcagatcgtattttcttatttggtgtaggttcatcaggtttaacggcagaagatgcccaacataaattaatgagaatagggctacacgcggctgccgtgactaataaccattttatgtatatgcaagcagcattgctgaaaaaaggagacattgttattggcattagccattctggttattcagaagaaacgacaaaagctctaaaaatatcaagagataatggggcaataacagttgctattacccataatttgcgttcgcctattacagaagaagcggattatgtgttaattaatggtaaccgtcaggggcatatgcagggagattcaattggtacaaaaatgactcagctttttgtactagatttaatttatgccttgttagtgaaagctgaaccagaaaaagcgattcaacaaaaacagaaaacgttgagtgttattttagatcaacggcttaagtagtttacaagcggtcagtttgatagtttttttgtgaaacagaccgctatcatttatctatactttactttaataaggaaacccatatgaaaaatttaaaaggtattttcagtgcattattagtttcttttaatgcagatggcacaatcaacgaaaaaggtttacgccaaattatccgttacaatatcgacaaaatgaaagtcgatggcttgtatgtaggtggttcaacaggtgaaaactttatgctatcaacggaagagaaaaaagagatctttcgtatcgcaaaagatgaagcgaaagatgacattgcattaatcgctcaagtcggtagcgtaaacttaaaagaagcggtagaacttggtaaatatgcaacagaattaggctatgacagcttatctgcagtaacaccattctactacaaattcagcttcccagaaatcaaaaacctctacgaaaccattattcgtgaaacaggtaacaaaatgattgtttactctatcccattcttaacaggggtaaacatcggcgtttcacaatttgcagaactgttccaaaatgaaaaaatcattggtgtaaaattcaccgcaggcgatttctacctgttagaacgtttacgcaaagcgttcccgaaccacttaatctatgcaggttttgatgaaatgatgttacctgcaaccgtattaggtgtagatggtgcaatcggtagtaccttcaacgtcaacggtatccgtgctcgtcaaatttttgaattagcccaacaaggtaaaatcaaagaagcgcttgaaattcaaaatgtgactaacgatttaatcgaaggcattttgggtaatggtttatatcaaaccatcaaaggcttattgaaagaagaaggcgtacaagcaggttactgccgtgagccaatgacgaaagaattgaatgcacaacaaaaagcggttgtgaaagaattaaaagcaaaatatctttcataagtaaccctcctataaatattgatagtttttgtagaagatcagaattgatcttctacaaatgtttcatttactttttagcccttccgcacaagcaaatgccgacgaccacgcccattggaaattatagccgccgagccagcctgtcacatcaagcacttcaccgataaaatataaaccctgaacgtttttcgcttccattgttttggacgaaatataatcggtatcaacgccacccattgtgacttcagctgtgcggtagccttcagtaccgtttggtaaaaactgccagtgatgaataaagtgatctaaaaaagcaagatccgacttattcagttgagcgataatctgatctttgatcatctgttgctcaatccacagttcgactaattttttcggtaaatagcgagataatacggtttttaattgcaatttcggcgaagattgacgcaatttgttcaaaatatcaaggatagaggaggacggcagtaaatcaatttccaccgtttcacccaaatcccagtagtttgaaatttgtagaatagcaggcccagataaaccacgatgggtaaacaacatctgattgctaaaggttttattgcggttgcttacgctaacgggtaaagcgataccggataaggtggcaaaaatcttatcgttttctttccaagtaaacggcacaaggcttgcacgaacagggataacgggaataccgaactgctcggcaattttataaccgaatgagcttgcccctaagccagccattgacaaaccgcctgtagcaataatcagattttccgtctgatagctttcgcaagcggtctgaatgtggaaaaaatttgcagatttttcgatggaactaaccacttgtcgaagccgaatatctacgttgcctttctcacattcggcttgtagcagatcgacaatctgttgcgagctttcatcacagaacagttgccccaactctttttcgtgataacagatgccatagcttgctaacagcgaaataaaatcccagttggtatagcgagccagtgccgacttgacgaaatggcgattttggcaaatataatggttgggggtgacatctagattggtaaaattacaaaagccaccgcccgacattaaaatcttccgcccgatttttttgccgttatccagcaccagtaccgattttcccccttgcccgagctgtgccgcacaaaataaacctgctgctccagccccaatgatgattgcatcaaattgtttcatatcgccctttttattcaaaaaatcctttataaacataatcttatgctttttcgttaatccgctatgaagcgataatttctgtttcagttctttaaataacccttccaacctatttgttgttttttctatatttaaatgagtatattcttcaaaagtgagcttaaagccttgtactataaggctttagcccactttttaccaacacttttgtctactatgcaaaatatcctatctaaatcaccgctttcattagatttccgcctattatttctaacttttattgataaaagttgaaaaattcttgttattttattcttagttttgtgtaactcttgttttttttttttttttttttttacaatggggtgggggaaaggtatttttgagatttccccacttgtgggggaagtagcttgtagggtgggtcttgacccaccatgtagccgtaacatattgattttattggtgggttaaaacccaccctacaatattcaatccatctaatatatggtttgtcaaggagttaacttcccccgcttgcgggggaagtgcccgagcgaaagcgagggcgatgggggcatttgtgcatcctgaaaatgtaaataaaggtttatgattttttattaggaaaagcaatagagaaggttattatgaataaaatatttagagttatttggagtcatgctcaacaggcttgggtggttgtatctgagttagtaaagtctcataccaaaacatccgcttgcacggataaaagagctcaagtatgcacctcagattattttttagataaacagcaagataaatttaaattaagtcttttaagtctagtattactaggtatattttttagtccagtaggtttagctgcatatattcaagatggttctgaaagaggaagtgacgctgacactggttctattggtattggtcaaaatagtagggttgggcctggttctattgtcatcggtcagggcgcaaaagctgaaggtaggactagtattgcgataggttatcaagctgaaacaaccggtgacaaagccgtagccgttggggcaactgcacaagcattcggttattctgcggcttatggttatggagcacaagcaaaagcaataggcgctgttgcagtcggtcaagaagctattgcaaatcaaaatggaggcgttgcattgggttaccaatcatctgttaacgttaccaatggtgttgcattgggttctttctctagcgcagatacgaaagggggtattgaaggagcaaaacaaactttttctgtgacagagggagcaagcactgttgagaatggatttaaatccacagaaacacctaatattggtgcggtttctgttggtagaagttttgcttggaagaatttcaataaaccaatcaaacgccaaatcaccaacgttgcggcaggtacacaagataccgatgcggtaaacgtggcacagcttaaatcgctcaccatgcaaataggaggcgataacggcagtagtggcaaggtaggcatttggagtggtatgctcactgtaaaaggagaaaatggtattacttccgatgttaaaggcagtacgattacggttaaattagagcaagaactcaaagataaaattgataagattgccgctatgggtaagttaattgaaagtacgaaaaatgaacaaaatggcgatctaacaattacctatacagatggttcgtatgacactatcaagaaaggtgaaaaaggagatcgtggtgaaactggtcctgcgggtccagcaggtccaattggaccacaaggtgcacctggtcctaagggggataaaggcgaacaaggtctaagaggtgaaactggccctgcgggtcctagggggccagagggtccgaaaggtgatacaggtgagagaggtgcaactggccctgcgggtccagtaggtccagcgggaccacgaggtgcacctggtcctgcaggtccaaaaggagaggcaggagcaaaaggcgaaactggtcctgcgggtcctaaaggagatgcaggtccaaaaggagatacaggtcctagaggcgaagctggtcctgctggagcaacaggaccacaaggtgaaaaaggagatcaaggtccgatgggtccggcaggcccagcgggtgctcagggcatacaaggtcctaaaggagatagaggtccaaaaggtgatacaggtgagagaggtgcaactggccctgcgggtccagcgggaccaattggaccacgaggtgcacctggtcctgcaggtccaaaaggagaggcaggagcaaaaggcgataagggtgaccctggtgaagcgggaccagtcggccctcaaggtcctgtgggtgcaactggccctgtgggtccggcaggcccagcgggagagcgaggcgagcagggtcctaggggagataaaggtgaaactggtcctgcgggtccaacagggcctaggggtgaacagggtcctgaaggtaaacaaggtattcaaggacctacgggtccaatgggaccacaaggatcgcaaggaatagcgggtactcagggacagaagggggataaaggcgatccaggacaagcgggtcctaaaggagaaaaaggagatacaggtcctagaggcgaagctggtcctgcgggtccagcgggaccacgaggccctgcgggtgagcgaggccctgcaggtgaaactggtccagcgggagagccaggcaagcagggtcctagaggcgaagctggtcctgctggagcaacaggaccacaaggtccaaaaggagataatggagttccaggtcctaggggagagaaaggtgaacctggtccggcaggcccagcgggagagcgaggcgagcagggtcctaggggagataaaggtgaaactggtcctgcgggtccagcaggggctaagggtgaccgaggagaaactggccctgcgggtccaacggggcctaagggtgaacagggtcctagaggtgaacaagggcttccaggggtagcaggtcctaagggcgatagaggcgaagctggccctgcgggtccagtaggtccagctggaccacaaggaccgcagggaacagcgggtgctcagggacagaagggggataaaggcgatccaggacaagcgggtcctaaaggagaaaaaggagatacaggtcctagaggcgaagctggtcctgcaggtccaaaaggagaggcaggagcagtgggccctcaaggtcctgcgggtgcaactggtcctaagggggataaaggcgatccaggacaagcgggtcctaaaggagaaaaaggagatacaggtcctagaggtgaaactggccctgcgggtccagcgggacctaagggtgacaaaggtgatacgggtccagcaggatcacaaggacctacgggtccaactggaaattcggaattaaaaggcattacgtcgattgccaatggtaacgacgccaccaaggcgaatggggctaagattaccttgtctgcaggttctacagataaaacagttaatgttaatgatgcgaaaattaccaatgtggcggctggtacagcagataccgatgcggtgaatgtgaaacagttgaaatctgcgaaaactgaagtggaatctaccgatcacagtgtggtgattaaagagcgtcagggcgataatcagcaaatcgtgtatgatttggcggttgctaaaacgaaactcactgcctctaaggataaacgcaccattagtgcagcagataaaggcaaccattttgcgacaggagatgaagtcgcagtagcaattaataccgcaacagcagccgcaagaactgaagttgaagcgggtaaaaatgtgaaagtgacttcaaaaacgggggcaaatggtcagaatatttacaatgtgagcgtgtctggagatttaagcgacattacttcaattagtaatggcgatacgaaagtatctttaggtaaagataagcaaggaaatccagttgtaaatatgaatggcgccagaattaccaacgttggagatggtagtgctgagggcgatattgtgaatgttcgtcagctcaacaaagtggtttcttctgtgaatacaggatttaatcaattatcaagagatattgttaatgcaagagcgggtattgcttctgctggggcgatggctaatttgccacaaatttatttaccaggtaaaagtgctatttctgtttctaatgcacaatatcgcgggcaatctgcctatgctataggttattccagaacttctgataatggcaaatggcttattcgagcgtctgttagcagtaatactcagcgggatactatgattggaggaggggtaagttttgtgtggtaatctagcacctataaattagaatttcatgctcaatgccattgttattttaacaatggcattaatatctattggatttaatttatttgtggaagaaaaggttttatgacaggatgaacaaaagtacctctgaatattatttttctttccatgcttttggatattgttcttaaggcaaaaaggacagttttttgttcacattttaaaaagtgggcttaaagccttgtactataaggctttagcccacttttttaccaacacttttgtctactatgccagaaacagggtatcatcacctatcaagtacttgaattattaatgccgatctcaaccgcatttattgcttatctgctcctaggtgaaaccatttcatcaatgcaacttgtgtttgcagggattgtgattgttggggcgagtatggcattggggttattacattaaaggaaaagagagagtaaattatattattctctcctgaaaaactacgagcatagcagacaaaaataattaaagtataaaggcttgtctactatgcatttaaaattaaagtacttttacaatcgcttcacacaatgcgtcgatattatcttcggtaatacctgccacattgatacggcctgaacgcactgcataaatcgcaaattcatcgcgtaaacgatccacttgttcaggggttaagccactaaacgagaacataccgttttgtgcaatgataaaatcgaagttttgagttgcacctttctctttcaacaatgccacaaattttgcacgcatctctttgatacggttacgcatttcagccagttcttcaatccagttagcttttaattgtggatcagctaacactgtcgcaacggcacttgccccgtgtgaagatgggttagagtagagtacacgaataatcgattttacttggctgaacgcattatttgccacttctgcactatctgcaactaaggtaaatgccccaacacgctcattgtataaaccaaagtttttagaataagagcttgccactaacacttcacggtgatttttcacgaaggtgcgtaagccaaaggcatcttcctctaagccgtttgcaaagccttgataagcaaagtcaaataatggcaaccaacctttttccgcagacatattggctaggatttgccactgttctggagttgggtcaattccagttgggttgtggcagcaaccgtggaaaagcacgacatcacctttacctgcttggcttaaatctgcaataagattatcccaatctaatgctttagtttctttattgtagtaacgatattctttaatattgatacccactgcgttgaaaattgcattgtggtttggccaagttggggttgaaatccatacgttttgcgtattggtttggcgtttaacaaattctgccgcaatgcgtaacgcaccagtaccgccaaggctttgtgccgttttagcacgtccagaggtaattacttccgcacctgccccgaataataactcttgggtttgtgcattgaaatcagcaataccgtcaatcgttaggtaatttttggtattctctttagccagtaaacgcgtttctgcttcttttaccgctttaacgataggcgtttgtcctttcgtatctttataaaccccgatccctaagttgattttctcagggcgagtttctgctttaaatgcttcgcctaaacctaaaatagggtctgctggtgctgcttgaatgtggttaaacattgacatagttttccttttaatatgtgtttgcaaataggtggatttatacgaggatttataccttttggcaaggggcaagcggtgatttttagtaaattatttgcgaatagaataaaaatgtaaatattccaagctacgatattctttttacagtttgaacaagcagaaataaattagcacacaatcatcacttgaatgtgagataaattgctctataatgttgcacaaagtaacactgagagaggtagttatgcaagcgacattaagacaacaaggtggagccgctgtcttgactgtaccaatggcaatattgcaacaaatggggtggcaaattggtcataaagtcaatttggagacaaggggagaaagtgtcatactcacccctattaagcgtcaagcacgaggtcgtaagacagttgcagaattgttagcaggtattgatagtcaagaaattgcggagttgaatacaacagtggcagaattttcccaatctcaacccactgggaaagaagtatggtaatgcgtgttccgaaaaaaggagagatttggtatgttgatccagatccaacgaaaggtcacgagcttcgctctcctcattattttattgtggtatcggacgaattattgaatcaagcattaggcacagcaatttgttgcccaatatctacgggtggcaatgcggctcgttcgcagaatataactgttgtgcttgatggtagtagtacagaatcaggtaaggtaacaggtgttattttatgtcaccaagtaagagccttagatttaaaagaacgccaagctaagtatgcgactaaagcagaggattatttaattgacgaagtcattatgaaattagttgacttaattgatccacaataaaacatctagggctattttacatatgtatttttatataattttatgttttaatacgctcaattttctcaacacaattaaggtgtaacaatgagctggattgaaaaaattttaggaaaaacgtcctcatcatcaagtggtaaatcaaaaattccagaaggcgtttggacaaaatgtacaagctgtgaacaggttctttatagtgaagaacttaaacgcaatatgcaagtttgcccaaaatgcgatcatcatatgcgtattgatgcgcgtacacgtttattatcccttttagaccaagatactgctgaagaattagcggcagagcttgaaccacaagatgtgttgaagtttaaagatctgaaaaaatataaagatcgtttaagtgcggctcaaaagcaaacgggtgaaaaagactctttcatcgtaatgtatggcaagttgtatgatatgcctgtggttgttgcttcctttaactttgagtttatgggcggttcaatgggatctgtcgctggagcaaaatttgttcgtgcggcagaaaaagcattaagcgagaatattccgtttatctgtttctctgcgtcaggcggggctcgtatgcaggaagcattattttcattaatgcaaatggcaaaaaccagtgcggtgttggcaaaaatgaaagaaaaaggcgtgccgtttatctctgttttaacagacccaactttaggtggcgtatcggcaagtttggcaatgttaggcgatattaatatcgcagagcctaaagccttgatcggttttgctggtccacgagtgattgaacaaactgtgcgtgagaaattgccagaaggcttccaacgaagtgagttcttaatggaaaaaggggcgattgatatgatcgtacaccgcaaagaaatgcgtgatacccttgctcgtttgcttgcgaaaattactcatcagccaaccccatttaaaacgggcgaacttattgcagaagaagtgtaatgaacacattaatttcaccaaaagccacggattcattggaaacgtggctttcctatttagaaaaaagccatttcaaaccgattgatatgggcttggaacgtatccgaaaagtcgcggaagaattggatttactcaagccagccccttatgtgattaccgttgcaggtacaaacggcaaaggttcaacctgcaaattgctagaaattgcgttattaaaggcaggtctaaaggtcggagtttattcatcaccacacttaattcactataacgaacgtgtgcgtattcaaggacaagcggtcggaaatgctgatttaattgcaacttttgactatattgaacagcacaaatcagcctctttaacctattttgagttcggtactttagcagcgttagatctgttccgtaaggcaaaggttgatgtcgcgattttggaagtaggattaggtgggcgtttagatgccacaaacattgtcgatcctgattttgcggtaatcacttcgattgatattgaccacgttgagtttttaggcgataaccgtgaagcgataggtcgtgaaaaagcggggattttccgcccaaatattcctgtagttatcggcgagtctgattgcccccaaagtatcttagaccatgcaaaagagttgcaatgtcacgtttttagacgagatatagattggaaattttccgtcgaatctgaccgcttgcagtggcaatcgaaaaccaaatctttaattgttccactgcctaaaattccacagccaaactgtgccacagctttggcggttttaacccagttaccttttgaactcagtgatgaaattcttgttcaagcggtcgaagaggcgaagatgacagcgcgttttcaattattaggcgaacaagattttgcaactttttcacaaaatagaccgcttgcacaggtgattattgacgttggacataacccccacgcagcacgttatttatcggatcgtcttgcagaatgggttcaacctaaccgcaaaatatatgcagtgtttagtgcattggttgataaagatttatcgggtattgttgagcctttggaagagttgattgacgaatggcattgtgctgggctacaaggttatcgagggcaacgtggcacagaggtaaaaagtaaattacttactgccttaccaaacgccaaagccgttgcctatgaaaatgttattgaagcaagccaagttctttttgaaacagcgaacgaacaagacattattcttgtgtttggttcatttcatactgttgcagattttgtgatgtggattgaacagtaggatatgaaaaacggtaagtttggcgacttaccgttctgttcatttactttttactagaatgttcagccattttacgtctaatttctcgacgctctttagaaagttcagcattacggatagcataatcatcaactcggttttcatagtcatctctcatgttacctatgattacacgtatgtcttggatagacatattgtcagtaatgtactgatttagattatcaagtaataaaatacgcttttgattatcacggattttgcgatcattatctgctgtttcacgtaataatttattttttaaacgataaagatgcacataatctagcatatcttgaaatgattgttttttgctattttccatctatagttcctctattttgataaaagattcctgttatgctagacgttttatactctatcgtcaaaaggtttatataaaaattttcaagaagttgctctaaatcaatcctaagtaaaggatattggataagaaaaatagcactgttatttaacagataatctatgctaaaatcggaagatcgaatattgagaaaatttaaatattgggagaaataaatgatgagtgcaaataaacgttctgttccgacgcttttttctactaaaacagatatttatagtcatcaagtgcgtatcgttttagctgaaaaaggcgttgcttatgaaattgaaaatattttaccaggcacaatttcggaagatttaattgaagtcaatcctagaggtactgtgccagtgttggttgatcgtgatctcatattatcaaatgcacgaatcattatggaatatcttgatgaacgatttcctcacccgccattaatgcctgtttatcctatactgagagctcaatgtcgtttaaatatacatcgtattcaaaatgattggttctctttaattgattttattgaacgtgatccaactacagctgaagctcaaagagcattaaatcagctacgcgaagaagtattagcattaggtccagtattttcagattctgattattttttgagtgaagattttagtctagttgattgctatgtagcccctttattgtggagaatgaatactctaggtgtagaatttaatggggcaggctcaaaagcggttaaagcatatatgaatagagtttttaaacgagatagctttgtgcaatctattggaggtagtacacccaaaaatttaatggatgataaagactgatatgaaacctttaagaccttatttataccaagcctattataattggattttagataatgaaaataccccatatttattaataaattcggagtacgtagatacagatgttccccaagaatttgtgcgtgatggtaaaattatcttaaatatttctccccgctctataggacaatatgttgttactgatgaagcaattagtttcaatgcaagatttcagggaattactcgtggagtttatattccattcggtgctgtcgaggctatttatgcacaggaaaatggtgacggtgtaatgtttcaagaagaagctttctatcaagaagacacatatttagatagagtaaatagagcgcagtcactcaaaaaagttactaagaaaaaatcatctcatttaaagttggttaaatgagttatctgagggggaaatagtgcattcccccttctgtctagtttaaaaaacaaacgtttattatattatttccttatttcgattagaattttcttgcaatagtatattaatttttatatccttatttgtactattttaatagtatattaatacatcaagttaaattaaggaaattcatatgaaattgagaaaaacaattcttttttctgcacttgctgctttcgcatttaatgcatctgcgcagaataaaatccataatgttgcaattactgcaattgtggagcatcctgcattagatactattcgacagggtgttattgaagaactcgctagagaaggctttgttgatggaaaaaatattagtattaatttccaatctgctcaaggtagtacatcaactgcagctcaaattgcacgtaaatttgtaggtgataaaacagatattattattcctattacgacaccaagtgctcaacctgttgttgcagcaacacgttcaattcctattgtattttcaggtgtaacagatcctgtagctgccaagctgattaaatcttgggaaccaagtaaaacaaatgtaacgggtatttcagatcataaaccaattgaaccacaattggcactaatccaaaaactagtaccaaatattaaagctctcggatatgtttacagtgcaggagaggtaaattcagctgttgtgttagaagaattaaggaatgcaataagaggttctaatattgagattatgcctgtagctgtgcagcgtagtgcagatattggcacagctgctcgtagtttaagtggaaaggtgcaagctatttatattacagaagataatgctgtagtatctgcctatgaagcattacacaaagcagcacttgaagcaaaaattcctgttattgctgcggataaagacactgtaaaaagaggagctctagctgcttacgcagtgaatcaatatgatattggtgcagaaacaggtaaagttgcagcaaaaatcctcagaggcgaaaaagcaggtaatatcgcaacccagtctgtaagtaaaatggaattatccattaatcaaaaaacagcaagacaactgggactttcaataccagaatcattgcttcaagaggcaaaagaattattctaacatatcctaaagaataatatattgggctgtataactgacgtatttaaacggactgagtccagtagcaactggattcagtctttgaactagcagtttatttttttactgagtcgcctgaattgccgttaatgcaatggtataaacaatatcatcaaccaaagcaccacgagataagtcgtttacaggtttacgcataccttgtagcattggaccgatagacacgagatccgcagagcgttgaaccgctttataagttgtgttacctgtgttcaagtctgggaagacgaatacggtcgctttacctgcaacaggggagttaggcgctttagagcgagccacatcttccataattgccgcatcgtattgtaatggaccgtcaataataaggtctgggcgtttttctttcgcaatacgagttgcttcagctactttttctacgtctgcaccagcaccagaagttcctgttgagtaagaaatcattgcaacacgagggtcgataccgaatgattttgccgattcagccgattggatagcgatttcggctaattgttcagatgttggatctgggtttaccgcacagtcaccgtaaacaagtacttgatctggtaataacataaagaacacagatgaaataatagagttacctggtgctgttttgataatttgcattggtggacggattgtatttgcagtcgtgtgaactgcacctgaaactaagccatctacttcgtttgcttctaacatcattgtaccgagtacaacagtatctaacagttgttcacgagcaacaacctcagtcatacctttgtttttacgcaattcgactaaacgagccacatagttttcacgcacttcagctgggtcaataatggtaatgcctttgcctaaagtaaccccttgagcttcagcaacacgttgaacatcagcaggtggcgctaaaagtacacattctgcaatgccacgttccgcacagagtgcagccgctttaacggtacgaggctcatcaccttctggtaacacaatgcgttttttcgcttcacgcgcaagttcggttaattgataacggaatgcagcaggggagaggcgacgagcgcgaactgcacctttagaaataccttcaataaagtctgcatcaaattgttctgagacatattgtttaatcgcatcaatacgctctttatcatcaactggtacttcaaggctgaggctttgtaggcttaatgcagtttgccaagtgtttccttcaatacggaaaattggtaagccagtttcaaaggcttgttggcaaagtttggcaatttgagtatcaattttgtagccacccgttaagagtaacgcaccgatttccacgccattcattgctgctaaagatgctgcaacgataacatcaggacgatctgcagaagcaactaataaactgcccgctttaaagtgatcaaccatatgtggtaggcttcttgcacagaatgttacactacgaatacggcgtttatgtacttcaccttcattaataattgccgcacctaggtgttttacaagatcgattgcacgggttgcaattaaatctgatttccacgaaatacaagctagtaatttgattggaccagctttgaacaggttttccatttcaagaatgttattgctgctgtgttggaacgagtcgaagatttcggttaaatctgggcgtgtacgacctgactcatcaacaggggcattaaatttgttaataaccacaccgagtaggttagggttgtggcgaccaccaaataaagaagctgccgcatcaatacgctctttaagctgagctggtttgtctgccgctggcgctgcaactaacacgatttcagcgtctaatgcttgtgcaatttcatagttaatgctgtttgcataagaatttttccgtgttgggattaagccttcaatcacaataatatcgcttgttttagcgagtttttgatgacgctcaaccactttttcaagtaatacatcggtttggttttttgcaattaatgtttccgcttcacttagcataaatggtgtacctgtttcggtactttgtgaaaggcggataatagtggttgaacggtcaagggtatcttcaccgctgattggttgagcaattggttttaagaaaccaactttcgcccctttttgttcaagggagtgtactaagccgaggctaacactggttaaaccaacaccagtactgatcggaattaaaataattgttctagacatcttttctttccatttaagcaagcaggtagatgatcgaaaaattttgcaaattttaagtggaatcgaaccgcttgtaatatgttaaaagtaaagaacctgccaaattgacaggttccagatattataacgctaagcgtgcggtatcttgtgcaataacaagttcttcatttgttgggataacgaatgctcggaatgtagaatctgcagccgtaatttcacctgatttaccaaaacgagcagccatgtttttattgctatcaactttaataccgaacagttttaggtagtttaaagttaattcacgcactggacctgcattttcaccgataccgcccgtaaatacgattgcatctaagtgatcatcacctaatgcagccatgtatgaaccgatgtatttcgctaaacgataacagaacacatccattgcacgttttgcttctgggtgagtagagtagttatcttctgaataacggcagtcgcttgtcacttccgttaaacctaataaaccagattttttcactaatgtatcttcaatttcttttacagacatacctaaagtattgtgcataaagaaaatgattgcagggtctaagtcacctgaacgagtacccattactaaaccttctaatggagtgaaacccattgatgtatcaatacattcaccattacggattgctgcaactgaagcaccgttacctaagtggcaagtaatcacgttcacttttgaaggctcaacacccacaaccttagcaacttcacggctcacataatagtggcttgtaccgtggaaaccataacgacgcacgccgtgctctttatataaagagtatggaagtgcatagagataagcgtgttcaggcattgtttggtggaatgctgtatcaaataccgcaacgtttttctcttttaattcagggaatgctttgaatgcttcttcaataccgattaagtgagcagggttgtgaagtggtgcaaatgctgcagcttctttgatacctgcaaccacctcatctgtaataacgatagatgaagtatatttttcaccaccgtgaacgatacggtgaccgatagcaccaatgctgtcttttaattctgcacttaaaatgtttttcacgatgtagttaagtgcttcactgtgagctgcaccagcacctaaatctacagcacctttctcaccgtttaatttccatttaatacgagcatcaactaaattaaagttttcagctagacctgataatttttcatcgccagaagcaggatcaaggatagcgaattttaaagatgagctaccacagttaagaataagaatattttttgacattgtcgaaacacctatgtgataagaaaaaaattacacctatgtgataagaaaaaaattaacacgttttggataaacgtgactgcgtacctatgatacgccttttacacttgaaaataaattgatctcagtaaaaaagggaagagaaaaagaaagaaaagccttaaatttatccgcttaaatttgttatttaacataatatcaattatgagaattttgataagggaaatttaaaagattaaacagcagatattttgcggaatttaagtttattgtcatcacgttatcgacacgttgtcacgatttatttgtaaaagcaaccccaagtttttggtccgcatttgctataattttccgtgtcttgcacgctttcaatatgtaatttttggtatcaagtgctaagtggttgatattcgccgttgccccttttaaggttgtggtttcgtttgctttaatggttataagcggtcggcgttgatttccgtgtggttttgtacctgtgaatcgctattggagtgccctttaccgatgcttaccgcgccttcaatatctaaccccgttgagccacccgatttccccacaaaccctaatactattttttctttttgccgtttatcatcttcataaaacggcgtttttcttgccactctcttgaaagcaaatctctcaagttgtagttttctgcttttagttcctcaatttctgcttgtaattgctcaattagctcaacttgttgcttttgttttctgaagttaaacattttataaccttaaatgaaaatctgaaaacttacaaataatccttgcttagttattacttgtaaactataatatacttgttttcgcaatagggcggaaataagaagagcggctttcaccgctcaactaaatataggaactaggattatgttagttaaagtgttaatccttattatcctgttattggtaagcgtgccagcttactaaggatagcgtaagacctagcgggtgccaccgctaggcagttcctaaactatacaaccaacattttaaaaaatcaagtaggtaactatggcaaattcaatgactgaacattctcgtaaacttcgctctaaaacggcgaacgaatataacaaacgtatgcttgctgaaggcaaagttaagcaattttctgtgcgtatggaaacgcctgttgcggacgaatttgcggctgtgcttgctgaaatcggtggcacaaaagccgaagccattaaaaaactttgtgaaatttatcggcaaaataaggcatagcaatacgcctgttggttaggcatttttcagggtcaagatgaaatctgccaatgcttttaaaaaatcaggtgtaagccacatcattacgcacattatgatcaataaactgatagcccaaacataacgcttggcaatctttgatttatccattagttctaacattttacaaatcccctccattacgctaaaatctatctgcatttggaagttctccatttgttattcattcagtttatgtcctcttagtgctttaagtggatatgaaaaaccccgaagtgttacagcacctcggggtttgtttttctttaaaactcttaattaaaagtattttgcgttattacttgtattacaattattaccatcttatacttattccaacacattaatgtaagaggataacacgatggcattaacagtaagactaccagacgaattacaacaacgcttagatcatctctccgttcaaacaggacgagcaaaatctttttatgttaaagaggcattagaagcctatttggaagatttagaagatttgctcttagctaatgctgttcttgagcgtgtccgttcaggtaaagaaaaaacctattcactagaggaagtcgagaatgagcttaacttggaacgtcatcttagcggaaaccgctaaaaagcaattagccaaactcgccaagaaaaatcctcaacaggcccaacaaattatccgctacctcaaaaccttagcgacgctcgaaaatccacgagatcggggcaaaggtttagttggcgatttatctggaatgtggcgttatcgtgtcggcgattatcgcattatttgccatattgataatggcgaattgttgataactgccttagaaatcgggcatcgaagagagatttatcattgatcaaaaccgaaacgctcatagaatggcttaacgtctttcttgatgatgtttcggttttgataatatagttcagtattcatttgataaacaacgataataaagcaatcattaatataaatagaataataatttttaagattttaaatgtaaacaacgtagttttaagtaatgtttttttaataccctttaagataaaaaacatggttttattgtaagaaaaactaaaaaaacacccaatgttttaaaaattaacagaccctatcccaaattctgtgtaaacacccatttcaacttaacggtgatcgtctaggcgatcaccaaaatcaatcataaatcgattcatcgccagtttccagttctgaatcggcattgtccattttttttgatgcatctttaatcgcaagccaaatcactttgaaaactgaatcatccgtcgggaatacatttcgttttttaatcacgcgacaaatcacgctattaagcgattccacggcattcgtggtataaatcgctttacgaatatcagccggataatcaaaaaatgtggcaatatttgcccagttatcttcccagcctttcgccacaagcgggtattttgcctgccatttttgcgaaagtgcggtcagattttcgcgagcctgtacttccgtcggggtctgataaacctgctttaaatctgcggtgacggctttgtaatctttccacgaaacgaatttcaagctgttacgcactaaatgcacaatgcaaagctgaaactacgatacaatctaggtaaacaattggataaaccgcatcaagtgggcgattttgccatgccattacgcgctctttcacggcgtcgataacgcgagaaatcaggctggttgatacatccgcatcatagagttctttgaacatttcaacgatttcctgattacttaaccccttggcatataaggcaataatctgctcatccattcctgtgatgcgggtttggtttttcttgataagttgcggttcaaaggtgccgtcacggtcacttttaggtttttggcaaattccgctgccaaggcgtgaagttgtttttcgttcataataaaatacctgtgtctgaatgtattatctcagaaacaggtatttacacaaattgtgggagaggctccttcatttagtaaaaatgtagcaactttacatcacaaaacatttctttatgtttttatttacttagatcaatttctgtcaataatttattaccaaattgctctctccacccacacaataactcaggtaacttttgcctatcctgcccatttctataccatttaaacaactgatttaattgacgcttactcgccaacaactcaatcgccaaattttcaggacaaacttccgcaagacgcttttgcaaacgtttgaaagtagttttgtagccagcctcatcaaccaaacgacgaataacaggcggatagttctctggcaaaatttgcttacccagctcgactaaccacaaaattttcttaccgtgaatacgcacttcatttgggtgcataaattccaacaagattgaagtatgtttcggttgtaatttagcaatttgtaacaaactctgctctttaataataaaatttaatgccaaatcacgtttttctgcttcttctatccgccacttagctaatatctgcaaaattgccagctcttgttggttaagttgccacgcattactgatttccttataggctttattcggatcttctacgatctgccgtttagctaacaaagttgcacactcttctacgacggcagtttgccacggtgtttttgctaaatcttccgccaatttgtgataaatcgtcaacaaataccacacatctgcacaggcatattgaagttgtatctcactcaaaggacggctcaaccaatctgtgcgagaagcccctttatccaattcaacctcaagataatgcaacgcaagtttggcaaagccaattgaaatacctatccccacaaaccctgccatcacctgcgtatctaacattggttgtggtaactgtttgaaatagtgttgaaaaacttccaaatcttcactacaagcgtgaagtaccttaagcacattttcatttgttaacaacgcagtaaaaggggaaaaatccgtaatacttaacggatcaatcaaatacacctgcttaccatcaaaaagctgaattaaccccaacttcggataataagttcgagtacgaacaaactcagtatctaacgcaatcaccgattgttctgcaacctgcagacacatctgagccaaactaggattatcatcaacccactgatattctatatacttattcattttttctaatactttccacgagttagcataattttccatcatttattttaaaaaataaaataattttgtgacatcactctcataattgaaggaaacaatttgccagacacattataaaaatagcacaataaagtaacgacttagggagtaaaaagattgtaaggattatagctatgaaaatcacctcttcggattataaatatcaacatctcggcacggtttaccgcttagttgaacaatttgagctgatttctcgtactgacttagcgaaattatcaggatttgcccctgcatcaatgacagtgctgacgaaaatactcattgaccataaactgattttagaaagaacctcacaaaatttaccctcaaggggcagacctgccgtagggctgtcggtttccccgttccactggcgttatctctgcttaacccttgcaccacaaaaactctctatcgcactttgcgatttgagtggcaagctcatttaccaacaacattatagcctgacttccgacgaatatcttagcttagatcagcatatcctgaactgcatacaaactttttccctcaacacaccgcttaccaacgaagctttgcttgccatttctatcagcgtagtggggaaaattgaccgcacaaaaacgattatcacgcaattagggcaacagcccctcacctgccctctcgttgaaacattgcatcgtcactttaatcaaccgattttactcaacgagcattttcaactctggcttctagcggaagcaaccttaggaagtttaattgccaatgacaacgttattttcttacagcttgatgatcaagtgaatttaagtgtattactcaaaggggcattactccatcaagacgaacataaacgaatgaatgttgataaaatgataatgccaaaattcagtccacttagtgatgaaattgctgaacaacagacagaaatcgaacgttatcaactcaccaatcaagtgactttccctgcactagccaacttgatcgaccgctattttgaccaccaacacacttgccttgaagataaaatcaactacttctgcgaacaagtagaagccgaaaaccctcaagcaatgcagattttatcgcatcttaccgacaaccttgcttatatgctgatgaacctaatcaacatattttctacggaaaaaattatgttgaactcaccgctattacgcattaaaaaaccactttttgaacaactgcaaaccaaactacagcaaaacttgcttcttaatgaactacgaattgatattgtcaccagccaatacgattgggacagccctctcattccttctattgcaattaaattaggcatttatgagggctgtttattaaaggggattgtagaggtgtaaaacgtagggtgggttttaaccaaccaattcaccaaaaataaaaggatgaataggatttgtgcggcgctgttttaattcccaaacatcataagcggcttgtaaacttagccataatctagccgaactgatccccgcttcttccaaagcaatagctaaatttgccgtcatcggagttttaccgtgtaatactcgagaaagtgtttcacgagaaaagcccaaatgttccgctaacgctttgattttaatattgttaggttcaataaatcctgttaataaaatttcccctgggtgagagggttttctttcgctcatattatctcctagtgataatcttcataattcaaaacataagcatcgccgtcaataaattcaaaagtaatccgccagttgcccgacacagtcattgaccaaatgccttccctatcgcctcttaatttatggcattgataaaaaggaagaaattcatcaacaacttttgcccgatctatcacatctaaaataccattgattttcttaatgtgatctatccgtagccctcgcgttataccttgtcggaaatattgctctagccccttatgtttaaaactcttaatcattacagctcccttcaaagagtgtgatataatcatatcacacaaaagataaaacactgtaataattattccctattcataataaagcaaaaggataaatttttattttttcgacgtagatcgaaaaaatgattttaaatgattgataattggataaaggacaaataagagtatatgagaacgccaaatgtggcgttcttgatttaacaattaacgacactgtgccttaaatcgcaatagatgatctaacaccacaattgccatcattgcttctgcaatcggcacggcacggataccaacacaagggtcgtgtcgccctttggtgactacttcgacgagttcattatgtacattcacactttttccaggtacggtaatacttgaagtaggttttagggcaatatgagcgatgattggctgacctgagctaattccacctaaaatgccacctgagtggtttgagcagaaaccttctggggtcatttcgtcacgatgttcactacccttctgttcaacgactgcaaaaccatcaccaatttcaacacctttgactgcattgatcgacattaaggcgtgagctagatctgcgtccaagcggtcaaatacgggttcacctaaaccaactgggacattttctgcaatcacggttaattttgccccaatagagttaccctcttttttcagctctcggattaattcgtcaaattgttccactgccacaggatctgggcagaaaaacgggttactattaacttgttgccaatcaatctgttcgatatttgcaacagtttgtgggtcgattttgactgagcctatttgtgataagtagcctcgaatttctacgccaaactgctcttttaaatattttttcgctattgcccctgccgctacacgcattgcggtttctctggcagaagatcgtccgccaccacggtaatcacgaataccgtatttttgttggtaggtataatcggcgtgtcctgggcggaatttgtccattatatcgccgtaatctttggaacgttgatcgccatttttgatgattaagccgatacttgtacctgtggttttgccttcaaatacgcccgataagatttggacttcatcatcttctcgacggggtgtggtatagcgagaagtgccaggtttacggcgatctaaatcgggttgtaaatcggcttcgctgagttccatattagggggaacgccatctacaatgcaacctaatgcaataccgtgtgattctccgaatgtggtgactttaaaaagttgtccaatgctgttacctgccatttgttttccttatttttattgttgggtataaaatcaataggttttaaaatggtgggttaaaaccccaccctacaaatctgatattccaaaaattgtttggggcaaatatgatttgtccctacaaatcatttgatgtcgctatttataccattttttaaatgcacttccatttgattgaaggtcattttaatttggtgttggttaaagagttctgtgatccgctgatagaggaaattgcgtgttgcggcacggtcgtctaattctggtacaaatacggtaaattcgtgttcgatccagccatcaccaaaactttgtaaattaatacttggcgatggttccaccattactttgggcgcttcgcttgcagcttggtttagtaagcgacgaatcagtgataaatctgcttcggtgctgattttcaaaataaactgtaagcgtgtgacggtgttattaaaggtccagttaataaatctatctgtcacaaaagcttggtttggtagtaccacttctttgttatcatcatcaatcaaagttgttgaacgtaggcgaatacggctgatcacccctgtaaaattgccaaccgttactttatcaccaacgcgaattgggcgttcaaataataagatcgtacccgatacgaaactaccgaaaatttcacgcaccccgaaaccaagacccacagataatgcggtgaaaatccactggattttgctccacgaaatgccaagagcggtaaaggcagaaatactaccgaaagtaaccatcagataggtcattaccgcagtgatcgtatgcggtgtccctttggatagtttaatccgtgagaagaaggtcacttctaaaatccctttcaggtttttcaccagcacataggtgacggtaatataaagtatcgaacgtaaaatattcaataaggtgatggactctaccactgtacctttagaggtagtttcgatgttttcccataaaatcacattattgagataataagcaatactgattaaatctgaccaaatcgcataaagcgatacgaataaaatcacccagccgattaaatcagctaaacggaaaatctgctcattaaccgttgaaatcttgatgatttcctctggtttctctctggcttcctctttagccccctgctctaaacgttctaaattttgttctctgattttttcccgttttttctgtaagcgacggtatgccattcgacgtgaagaaatagttaaagaacgataagcaaagtagcgtccaaatacccaaactaatgcgactaaataggtcgtaataatgtggtcgattaaataaactgccgtgtagtagtaacctaatacaatcagcacaatcaaggtaagcggtacgataaacagcacaaaacgcaagagtttaaacaggctgacactgcgttttttaccatcttccgttttagcattttcatactcttgaataccccgatctaatagagggcgtacaacaaaagtacacaaagctaaagcaactatcgtcacgacttgaccgatcacatcattagtaaacccgaccacctcaatttgagagaaaatcgaggaaactaagagcaacaccacaatccacacagactgcttaataatgcgttggaaaatttcgttacttgcttgtggcataccgaaatggcgataagctaacccatttggtcgcaatagtgataaaacggtagcaaaaaataaccaatattcaaaggcttcggttacccaagttgaagctaataatggatcaggcacaaataggtaaagtgccacagttgcaagggtcaaaaacatcaaaccgcttggtaaggctaatactatcgtccaaaacatcgcttctggtgtatgccaatggctatcattttttagggtattaacatggccaccaatggttgccaagcggtgttttatgtctgtttttttccaaataattaagccataaagggataacaaaatcgcaataaaagttagggttgaaggcaaattctgccccaaattttcaaagccaagatagtccgttaatgttgaaatctcagcaattgcttgttttggaaaggtttctaaccaagttaaatcaatcgggttattactttgaacccaaaaactttgttgttgtagctgattttgcaaggtatcactgatggtgataatctgcttttgtgtttgctcaatctcattagacaaattaagctgtatattaagcgttttaattaagtccgctaaaattttttcacgctcttttaagatgtctgttaaggttttgcgttccgcatcatcaaatagggttttgtgggtcgtttctaatttttcaataacgctattaaggttatagagttcatcacgtttttgcgataaatcaaaaatttctacccgtaaatttgcaatatctttggaaagccctttgattaagctatctgttggcaaagattgtttttgctgattaataatacgagatagcaccaaagtaccttgtaatgcactgatctgctcttcaatgtttcgctgggtttgtatcaaactgtctagtacatttttagcacgcaggctatcccgtgacaacgtattggttttttgtgtctgttcaaccaaaaattgacttaaatcggtgtttaatgaaagctcatcgtgaataatcggattttcaactttattgttagcttttagttcttcagcctgttttgcttgagcctcaaactcttttaaacgcttggcatttaagacttcctgtaacgttgcctgctgtttctgtaacaattgctgttttaacgttaattcattacgtttcgcctctttcaacgaaatcagcagatcaatgttttgtgctaaatattgattatatttattacttgcctctaggtattttaattccgcattgtatttatcaatcagcgatttacttgcttggttattgtgttttaaacgtgttaatttatccgcttgttgattattttcggtaatctgttttcgtgtttgttctgaggctgtacgataagttaccgcactagagtttgtttcattcaaggtcaattgaacattgtttaactcttgacgggtattgtctaaacgttttctaactcttcattactgagtttactggaaatttcaacttcactgtttaactccttagttaatttgtcgatatttttcttataagtatctaaagttgcagttgcattagtaagttttttttctaaagcctctaattcactattttgatttttagttttctcaatgaatagcaaggcttcttcaatgtttttgaccggttcagttgtttgctcagaaggattggtttttattgcttctaactgcgttttcaaatcttccgcagacacaaaatcttccaccgcagactgaaccgtcgccgtgaaaaaagataaacataacgcaagccaaaatgattttttacacatttttttctctcaacttgttggcgatatacgcttttaaatgggttctagacatcttaatgccatttgattgccctatctcatcttccaaagggaaataagcaatcggctgtttgaatttttctaatcgttgcattgcaaaagatttcaacagattgaccgcttgtattgaaaaaggttcgctaaaagccactaacgccacaggacgttcgccaaattcttgatcggcaactggcacaacaaacacttgttttacaagcggatatttttgtagcaccttttccacttcttcgggctgaatattttccccgcccgaaataaacatattatctaatcgccctagcacttccaatttgccattattccaacgccctttatcttttgtcgcaaaccagccttgagcattgtgtaaggcaacaattttaccttgttgccaatagcctaacgcaaggctctgcccttttacccaaattccccctctacgagggtagcttctcgatttgctaacggtttgccaacattatcactctcatttttaacagcacaaatggtcgatgccatttctgtcattccatagcctgcataagttgtgatctgatgctgttgagcttgttcaattaaatctgccggaattgccgagccacctaataaaatatgctgtgatactaacttttcaccaagccaagctaaataacgctgtaattgtgttggtactaaagaagcgtggctgacttgcgataacatttgccaaaattccgctttatcttccgtcagataaaggattgccccttgcgataaccaacgccaaacaatcccctgccccgaaacgtgaaaaagaggcaaacttaacaaccaagaacaatggcgatcaaattgaacaaaatcacagacactgattgcattggcaagatgttgagcaatagaatgcactaccgctttgggattgcctgatgaacctgacgtaagggtaaaagtggctggtttatcgaaagaaaataagccattgtcttgattttctagataactgaaaacccctatctagagaataaaaatcctgatcggtcagcaaaatagatacttggttttgttgcaatatctgttggcgttggatctcgctcattgcaggattaagcgttaagatctttctgccacttgccaacacagcacaataacagagcaaaccgattaaacggtgagaacctgaataagccaccagctattcggcaatgctaactgctcaagcaatctcaccgctgttcaatcaacagttgcaactgttgccacgaaatttgacggggtaagtaagaaaacaaggtagcatttcctctatcccaaacaatagcaatatcttgagcctgtttttctgcccaatatattgtggggaatgtcggaaatactacccttgacatagattaattgaattgagctttaatacgagcaactaactcttcaggtaattccattgcattcattaatgcacacaaaataatcccttttcgttccgtattattattcgtaatcacccaaaatggcgactctggaatttgcttcgctttaacactcgaacccgtcgcaagaatagtttgttcatcacgagcaaaataaattcgctcactgccctgcacattttccgtcgctgagaaaagctcctaggatctgctttatacaaggcagacaacaagtgaaaaaacgatttacgccttttttttcattgttaaaaggctcgaagccaacacaaattcaacttgcttaatcaccttatcttgttgatggagttgtttcttttgttaggcagctttgcaagatctttcaattcattgatcatattctcttgcacaagtacaaaaaggttggggagatgctggtaaacggagtaaacgacgtaaaatatctgacgcactttccccaatagcctgagttctgcttgcaatatagtggtataattcatcatcaacttcgattgttttcatctttgtcccctaaataacttgattactggaaattctaggcattatatagcatttccgatctttttaacaggatctaaacacgataattgaataaattttaattaaattatggcggaaaaatgtttcttcatcaccaatttcaacaagaactaacccagcgacttcatcaccaaaacaatggtcttattcacggtttatttggtgatatgaataacttaggcgtaattgccagagcctttgcggaacagttttaatctactccgcatcgatctacgcaatcacggggcaatcttccacagtgatgaaatgaactataccttaatggcagaagatctgcgagatctactcaaccacttacaacttaacaatgttattctcgttgggcattcaatgggaggaaaaacagcaatgatgttagccaacatcgcccctgagcttgtggcaaaactaatcatcattgacattgcccccgttgcttaccacctcaaccgccacgacgacatttttgcaggactttttgcggttaaagctaccaaaccagctaaccgccaagaggccaaaacagcaattgcaaaaggtattcaagatgaaggcatacaacaatttatgctgaaatcattcgatccacaaagcccagaattctttaaatttaatctatcgggtttaaaacaaaactacccaatctaatggattggcaaaatgtttttgtggataaacctactctctttatcaaaggggcgttatcggattacttacaagaaaaagacacccaaaccatcttagctcaattcccacaagcaaaatcctttattgttagcggtgcagaccattgggttcacgcagaaaaaccagaagctgtggtcagggcgatggttaagtttatataaaaatgcccctaatttactaaaaatcaaaggggatgactgctttctaatccagtctccccttacttctcatcaaataataccaaagtgtttttcggacaattctaaatgagtagtcaactgagcaaaaatgatgtcattaccgccagtgaccctatcccaaattctgagaagcattttcttttccaccttgacttattgctgctacaaccgctccaacacctaaaatccctccaccgagataagctaaattagaaataacactactactctgagaagcaacatctgacaccaaagttgtattttcaactacttccgtagaagatacagaagattcattctttttacttcatcaatatctgtagattctgaagtggtgacattttcttctactttttctgtatttgaatcaatataatcttctattgatttttttatatttttctttaattgtgttcgacgagctttggttgagaatatctcttctttatcaaaaatagcttgaacatctcgcatgtgcaacactttactaattaagtagacagttctctacaaataagagagaattgtcaagataagctcttttattttcaatagtatttatattccaatgaccactgaaatcaactacgaaggcgttgaacaaatgccgattaagcgttttacggaagacgcttatctcaattactcaatgtatgtcattatggatcgtgctttgccttttattggcgacggtctaaaacctgtgcaacgtcgtattatttatgcgatgtctgagcttggcttaaatgcggcagcaaaatataaaaaatctgcacgcactgtcggtgatgtgctaggtaaatttcacccgcacggtgatattgcctgttatgaagcaatggttttgatggcacagccgttctcttatcgctatccattaattgatggacaaggaaactggggggcaccagacgatcctaaatcctttgctgcaatgcgttataccgaatcaaaactctccaaaatggctgaaattctattaggagaattagggcagggtaccgttgattatcagccaaactttgatggttcattagaagagcctaaatatctgccagcccgtttacctcacattttattaaatggcacaacaggtattgctgttggtatggcgacagatattccgctcataatattaacgagttagcggcagcttcagtaaaattattggataatccaaccgctagtcttagcgatattttggacgtggttcaagggcctgattacccaacagaagctgaaattattacaccgcgctcagaaattgcaaagatttatgagcaaggtagaggctctattaaaatgcgagcggtatggaaacgagaagagaataatattgttatcaatgccttacctcaccaagcctcgccatctaaagtgattgaacagatcgcaacacaaatgcgaaataaaaaattgccgatggttgatgatattcgagatgagtctgatcacgaaaaccctatccgcattgtgctagaaccacgttctaaccgtattgattatgatggcttaatggatcatctgtttgctaccactgatcttgaaaaaagctaccgtatcaatatgaatatgatcgggcttgatggtaaacctgcggtgaaaaatttgctgaccattcttactgagtggttagcattccgtagaacaacggtcacacgtcgtttaaatttccgcttggataaaatcatcagccgtttacatattttagagggcttgatgattgccttccttaatattgatgaagtgattgagattattcgcaatgaagataatcccaaagctgaattaattgcacgttttcaattaagcgatgagcaagccgaagctattctaaacttacggttacgccatttggcaaaactggaagaacacgagttaaaagcagaacagcagaaacttgaagaagaacgggaacatttgcaagggatcttaggttcagagcgtcgtttaaataacttgattaagaaagagattgaagccgatgccaaggtctttgccagccctcgccgttcaccacttgtggagcgtgctgaagcgaaagcgatttcagaaagcgatttaacaccaacagagcctgtgacggtaattctttccgaaaaaggctgggtac
